US012753409B2

(12) United States Patent
Huang et al.

(10) Patent No.: US 12,753,409 B2
(45) Date of Patent: Oct. 6, 2026

(54) DOUBLE-STRANDED RNAi AGENTS FOR TARGETING AND REGULATING HBV GENE EXPRESSION, AND A USE THEREOF

(71) Applicant: HANGZHOU TIANLONG PHARMACEUTICAL CO., LTD., Hangzhou (CN)

(72) Inventors: Zeao Huang, Hangzhou (CN); Gengshen Song, Hangzhou (CN); Shuo Yang, Hangzhou (CN); Yang Yang, Hangzhou (CN); Zhikang Tian, Hangzhou (CN); Yucheng Wu, Hangzhou (CN); Kai Xiong, Hangzhou (CN); Zhongcai Gao, Hangzhou (CN)

(73) Assignee: HANGZHOU TIANLONG PHARMACEUTICAL CO., LTD., Hangzhou (CN)

( * ) Notice: Subject to any disclaimer, the term of this patent is extended or adjusted under 35 U.S.C. 154(b) by 0 days.

(21) Appl. No.: 19/263,112

(22) Filed: Jul. 8, 2025

(65) Prior Publication Data

US 2026/0125681 A1 May 7, 2026

(30) Foreign Application Priority Data

Jul. 8, 2024 (CN) ......................... 202410909405.0
Jan. 9, 2025 (CN) ......................... 202510037618.3
Jan. 9, 2025 (CN) ......................... 202510039392.0
Jan. 9, 2025 (CN) ......................... 202510039613.4

(51) Int. Cl.

*C07H 21/02* (2006.01)
*A61K 9/1272* (2025.01)
*A61K 9/51* (2006.01)
*A61K 31/712* (2006.01)
*A61K 31/7125* (2006.01)
*A61K 31/713* (2006.01)
*A61K 47/02* (2006.01)
*A61P 31/20* (2006.01)
*C07H 21/04* (2006.01)
*C12N 15/113* (2010.01)

(52) U.S. Cl.

CPC ........ *C12N 15/1131* (2013.01); *A61K 9/1272* (2013.01); *A61K 9/5123* (2013.01); *A61K 31/712* (2013.01); *A61K 31/7125* (2013.01); *A61K 31/713* (2013.01); *A61K 47/02* (2013.01); *A61P 31/20* (2018.01); *C12N 2310/11* (2013.01); *C12N 2310/14* (2013.01); *C12N 2310/312* (2013.01); *C12N 2310/315* (2013.01); *C12N 2310/321* (2013.01); *C12N 2310/322* (2013.01); *C12N 2310/351* (2013.01)

(58) Field of Classification Search

CPC .......................... C12N 15/113; C12N 2310/14
See application file for complete search history.

(56) References Cited

U.S. PATENT DOCUMENTS

2021/0332365 A1 10/2021 Jadhav et al.
2021/0395745 A1 12/2021 Given et al.
2022/0042020 A1 2/2022 Tanaka et al.
2022/0339256 A1 10/2022 Pang et al.
2023/0220386 A1 7/2023 An et al.
2023/0340483 A1 10/2023 Haba et al.
2024/0124879 A1 4/2024 Hong et al.
2024/0252435 A1 8/2024 Song et al.
2024/0271141 A1 8/2024 Shu et al.
2024/0309383 A1* 9/2024 Zhang .................. A61K 31/713
2025/0109092 A1 4/2025 Song et al.

FOREIGN PATENT DOCUMENTS

AU 2024339209 A1 5/2025
CA 2833778 A1 1/2013
CN 101603042 A 12/2009
CN 103582648 A 2/2014
CN 112673103 A 4/2021
CN 113430196 A 9/2021
CN 113699151 A 11/2021
CN 115677518 A * 2/2023 ........... C07C 229/16
CN 115745820 A * 3/2023 ........... C07C 229/16
CN 115784921 A * 3/2023 ........... C07C 229/16
CN 116854754 A 10/2023
CN 117043338 A 11/2023

(Continued)

OTHER PUBLICATIONS

Elbashir et al. (The EMBO Journal, vol. 20, No. 23, pp. 6877-6888, 2001).*
Parrish et al. (Molecular Cell, vol. 6, 1077-1087, Nov. 2000).*
Zhang et al. (Arch Virol (2017) 162:349-357).*
Fujita et al. (Int. J. Mol. Sci. 2015, 16, 5254-5270).*
Friedrich et al. (BioDrugs (2022) 36:549-571).*
Long et al. (Adv. Healthcare Mater. 2023, 12, 2202590, 1-14).*

(Continued)

*Primary Examiner* — Amy Rose Hudson
(74) *Attorney, Agent, or Firm* — Maschoff Brennan

(57) ABSTRACT

The present disclosure provides a double-stranded RNAi agent for targeting and regulating HBV gene expression and a use thereof. The double-stranded RNAi agent comprises an antisense strand and a sense strand complementary to the antisense strand forming a duplex region. The nucleotide sequence of the antisense strand is as shown in SEQ ID NO: 8, 11, or 13, or the nucleotide sequence of the antisense strand is a modified sequence of the sequence shown in SEQ ID NO: 8, 11, or 13. Results from cell and animal experiments demonstrate that the double-stranded RNAi agent provided in the present disclosure can significantly reduce the expression of one or more HBV genes, block the viral life cycle, and can be used to develop drugs for treating diseases related to HBV gene expression.

12 Claims, 7 Drawing Sheets

Specification includes a Sequence Listing.

(56) References Cited

FOREIGN PATENT DOCUMENTS

| | | | |
|---|---|---|---|
| CN | 117210468 | A | 12/2023 |
| CN | 118146284 | A | 6/2024 |
| CN | 118147134 | A | 6/2024 |
| EP | 4023659 | A1 | 7/2022 |
| EP | 4442827 | A1 | 10/2024 |
| EP | 4585603 | A1 | 7/2025 |
| EP | 4588910 | A | 7/2025 |
| EP | 4596529 | A | 8/2025 |
| TW | 202023574 | A | 7/2020 |
| TW | 202329987 | A | 8/2023 |
| TW | 202340136 | A | 10/2023 |
| WO | 2012145697 | A1 | 10/2012 |
| WO | 2016077321 | A1 | 5/2016 |
| WO | 2016077349 | A1 | 5/2016 |
| WO | 2020036862 | A1 | 2/2020 |
| WO | 2020191207 | A1 | 9/2020 |
| WO | 2022029209 | A1 | 2/2022 |
| WO | 2023093896 | A1 | 6/2023 |
| WO | 2024175111 | A2 | 8/2024 |

OTHER PUBLICATIONS

Ellen Van Gulck et al. , Retreatment with HBV siRNA Results in Additional Reduction in HBV Antigenemia and Immune Stimulation in the AAV-HBV Mouse Model , Viruses 2024, 16(3), 347, Feb. 23, 2024, p. 1-28.

First Office Action dated Jun. 30, 2025 for CN patent application No. 2025100393920.

First Office Action dated Jul. 1, 2025 for CN patent application No. 2025100396134.

First Office Action dated Aug. 15, 2025 for CN patent application No. 2025100376183.

EA Search Report dated Nov. 19, 2025 of patent application No. 202591773.

EA Office Action dated Sep. 15, 2025 of patent application No. 202591773.

EA Office Action dated Nov. 24, 2025 of patent application No. 202591773.

EP Partial Search Report dated Dec. 3, 2025 of patent application No. 25188148.8.

CN Office Action dated Oct. 23, 2025 of patent application No. 2025100376183.

CN Office Action dated Sep. 1, 2025 of patent application No. 2025100393920.

CN Office Action dated Oct. 30, 2025 of patent application No. 2025100396134.

Gupta Sneha V. et al: "Clinical and Preclinical Single-Dose Pharmacokinetics of VIR-2218, an RNAi Therapeutic Targeting HBV Infection", Drugs in R&D, vol. 21, No. 4, Nov. 6, 2021, pp. 455-465.

Van Den Berg Fiona et al: "Advances with RNAi-Based Therapy for Hepatitis B Virus Infection", Viruses, vol. 12, No. 8, Aug. 4, 2020, pp. 1-20.

NZ Office Action dated Feb. 13, 2026 of patent application No. 823143.

Extended European search report dated Feb. 25, 2026 of application No. 25188148.8.

TW Office Action dated Feb. 25, 2026 of patent application No. 114125688.

KR Office Action dated Mar. 20, 2026 of patent application No. 10-2025-0090998.

JP Office Action dated Mar. 24, 2026 of patent application No. 2025-114710.

* cited by examiner

DOUBLE-STRANDED RNAi AGENTS FOR TARGETING AND REGULATING HBV GENE EXPRESSION, AND A USE THEREOF

SEQUENCE LISTING

The instant application contains a Sequence Listing which has been submitted electronically in XML file format and is hereby incorporated by reference in its entirety. Said XML copy, created on Jun. 30, 2025, is named S3920.10196US01_Sequence_Listing and is 3,579,904 bytes in size.

TECHNICAL FIELD

The present disclosure relates to the field of nucleic acid modification technology, and specifically, to a double-stranded RNAi agent for targeting and regulating HBV gene expression, and a use thereof.

BACKGROUND

Nucleic acid drugs, particularly oligonucleotide drugs, have been widely used due to their simple synthesis and high activity. Oligonucleotide drugs typically include antisense oligonucleotides (ASOs), small interfering RNAs (siRNAs), microRNAs (miRNAs), and nucleic acid aptamers, among others.

Oligonucleotides are short DNA or RNA molecules or oligomers that can easily bind to their complementary oligonucleotides, DNA, or RNA in a sequence-specific manner to form duplexes or, less commonly, hybrids. This fundamental property enables oligonucleotides to have broad applications in gene detection, research, and medicine. In nature, oligonucleotides are often small RNA molecules that play a role in the regulation of gene expression or are intermediates derived from the degradation of larger nucleic acid molecules.

RNA interference (RNAi) is a natural defense mechanism against exogenous genes. siRNA can downregulate target genes by recognizing specific sequences and degrading the target mRNA.

An effective molecule of a classical RNAi consists of a characteristic 19+2 nucleotide polymer structure (a double-helix structure composed of a 21-nucleotide RNA molecule paired with a 19-nucleotide molecule of complementary bases, comprising a 3' end overhang of two nucleotides). One strand (the guide strand or antisense strand) of siRNA is complementary to the target gene's transcript mRNA, while the other strand is designated as the passenger strand (or sense strand). The siRNA (antisense strand) guides the Argonaute protein (AGO2) to complementary to the target transcript and becomes part of the RNA-induced silencing complex (RISC). The complete complementarity between the siRNA (antisense strand) and the target leads to the cleavage of the target transcript at positions 10-11 corresponding to the guide strand (antisense strand), catalyzed by the AGO2 protein.

siRNA possesses inherent advantages compared to small molecules and antibody drugs, as siRNA executes its function through Watson-Crick base pairing with mRNA, whereas small molecules and monoclonal antibody drugs require recognition of the complex three-dimensional structure of specific proteins. Therefore, many diseases cannot be treated with small molecules or monoclonal antibodies because their target molecules are highly active and lack identifiable molecular structures with sufficient affinity and binding specificity. The mechanism of action of siRNA drugs enables them to regulate the expression of target proteins at the genetic level, offering superior target specificity compared to small molecules or antibody drugs. The principle of base complementarity also allows siRNA to have a broader therapeutic range, simpler design, and shorter development cycles.

In natural oligonucleotides, nucleotides are linked by phosphodiester bonds, making them highly susceptible to nucleases under physiological conditions. As a result, natural, unmodified oligonucleotide drugs are rapidly degraded by nucleases in vivo, exhibit low activity, and have poor druggability. Chemical modification of oligonucleotide structures is an effective approach to enhance their activity. Such modifications can improve their stability against nucleases, increase their affinity for RNA, and promote cellular uptake and tissue targeting, thereby effectively regulating the expression of target genes.

Based on the basic structure of oligonucleotides—comprising the nucleobase, sugar ring, phosphate backbone, and terminal—chemical modifications can be performed in four parts:

1) Nucleobase modifications, which primarily include purine modifications, pyrimidine modifications, and nucleobase replacements. Purine modifications include N6-methyladenosine, Ni-methyladenosine, and 7-methylguanosine modifications. Pyrimidine modifications include 3-methyluridine, 5-methyluridine, 5-methylcytidine, N4-acetylcytidine, pseudouridine, thiouridine, propynyluridine, and dihydrouridine modifications, among others.
2) Sugar ring modifications, which mainly include modifications and replacements of the sugar moiety. Sugar ring modifications include 2'-, 4'-, and 5'-modifications, isomer modifications, and combinations thereof. Among siRNA modifications, the most common 2-modifications are 2'-OMe (2'-methoxy) and 2'-F (2'-fluoro). Compared to natural siRNA, siRNA modified with both 2'-OMe and 2'-F exhibits higher Tm values, stronger serum stability, and improved activity.
3) Phosphate backbone modifications, which primarily include phosphorothioate modifications; methylphosphonate, selenophosphate, boranophosphate, and dithiophosphate modifications, as well as the replacement of bridging oxygen atoms in the phosphodiester linkage with sulfur atoms; the phosphate group between nucleotides be entirely replaced with non-phosphorus groups, such as replacing the phosphorus atom with carbon (C), sulfur (S), or nitrogen (N) atoms, forming guanidinium or S-methylthiourea groups, among others.
4) Terminal modifications, which involve the covalent conjugation of special groups to the 5' end or/and 3' end of the sense strand, as well as phosphorylation modifications at the 5' end of the antisense strand.

Hepatitis B virus (HBV) is a double-stranded hepatotropic virus that infects only humans and non-human primates. It primarily replicates in the liver and can be transmitted through maternal-neonatal transmission, blood (including minor skin and mucosal injuries), and sexual contact. HBV infection remains a major global health issue. Chronic HBV infection has a high probability of progressing to liver fibrosis, cirrhosis, and liver cancer.

The current standard of care for chronic HBV infection involves treatment with oral nucleos(t)ide analogs (NAs) and injections of interferon-alpha. NAs inhibit HBV replication by suppressing HBV DNA synthesis. However, most patients require long-term treatment, and the rate of virological relapse after discontinuation of therapy is high. Interferon-alpha exerts dual effects of immunomodulation and antiviral activity by enhancing immune cell function, promoting cytokine expression, and inducing interferon signaling to encode multiple antiviral proteins. Interferon-alpha is effective only in a subset of patients when used alone and is associated with relatively poor tolerability. In the "Guidelines for the Prevention and Treatment of Chronic Hepatitis B (version 2022)", Entecavir, Tenofovir Disoproxil Fumarate, Tenofovir Alafenamide Fumarate, and Tenofovir Amibufenamide are recommended for nucleos (t) ide analogs, and pegylated interferon-alpha is recommended for a interferons.

The current treatment goal for chronic HBV infection is to achieve a functional cure, defined as sustained undetectable levels of HBV DNA and HBV surface antigen (HBsAg) after discontinuation of therapy, with or without HBsAg seroconversion. A sustained reduction in HBsAg levels and seroconversion are critical for achieving a functional cure. This is expected to alleviate liver inflammation, improve liver histopathology, reduce the incidence of end-stage liver disease, and prolong patient survival. Currently, achieving a functional cure through clinical drug therapy is difficult, or with a very low functional cure rate. Therefore, there is a need for further research and development of drugs that can downregulate HBsAg expression to achieve a functional cure.

CONTENT OF THE PRESENT INVENTION

To address the technical problem in the prior art of lacking a drug capable of more effectively inhibiting HBV gene expression, the present disclosure provides a double-stranded RNAi agent for targeting and regulating HBV gene expression, and a use thereof. By targeting the HBV genome sequence, a series of unique siRNA sequences are designed and modified with specific templates in the present disclosure.

Typically, siRNA is modified with 2'-methoxy (2'-OMe) and 2'-fluoro (2'-F) on the monomers. However, even when considering only the combination of these two monomer modifications, for an siRNA with 44 nucleotides in total (including both the sense and antisense strands), there are 24 possible modification combinations. Furthermore, the addition of different terminal phosphorothioate modification patterns significantly increases the number of possible modification patterns.

The activity of the same siRNA sequence can vary greatly depending on the modification pattern, and different siRNA sequences with the same modification pattern can also exhibit significant differences in activity. Although there are some general principles for siRNA modification design, existing research has shown that it is not possible to accurately predict activity based on modification patterns, as there is no deterministic relationship between modification patterns and activity. Therefore, screening for highly active modification patterns from an enormous number of possible combinations is extremely challenging.

Through chemical modifications of the designed siRNA sequences, specific modified sequences that exhibit significant inhibitory effects on HBV gene expression were identified in the present disclosure.

In one aspect, the present disclosure provides a double-stranded RNAi agent, wherein the double-stranded RNAi agent comprises an antisense strand and a sense strand complementary to the antisense strand forming a duplex region, wherein the nucleotide sequence of the antisense strand is as shown in SEQ ID NO: 8, 11, or 13, or the nucleotide sequence of the antisense strand is a modified sequence of the sequence shown in SEQ ID NO: 8, 11, or 13.

In another aspect, the present disclosure further provides a conjugate comprising the double-stranded RNAi agent and a ligand conjugated to the double-stranded RNAi agent.

In another aspect, the present disclosure further provides a pharmaceutical composition comprising the double-stranded RNAi agent or the conjugate, along with a pharmaceutically acceptable carrier.

In another aspect, the present disclosure further provides a kit, wherein the kit comprises a kit A, and the kit A comprises one or more of the double-stranded RNAi agent, the conjugate, or the pharmaceutical composition.

In another aspect, the present disclosure further provides a use of the double-stranded RNAi agent, the conjugate, or the pharmaceutical composition in the preparation of a medicament for preventing and/or treating a disease associated with HBV gene expression.

In another aspect, the present disclosure further provides a method for reducing HBV gene expression or inhibiting HBV replication for non-preventive and/or non-therapeutic purposes, wherein the method comprises administering to a sample one or more of the double-stranded RNAi agent, the conjugate, the pharmaceutical composition, or the kit.

Based on common knowledge in the field, the above preferred conditions can be combined in any manner to obtain various preferred embodiments of the present disclosure.

All reagents and raw materials used in the present disclosure are commercially available.

The positive and progressive effects of the present disclosure are as follows:

(1) The sequences or modified sequences of the present application exhibit significant inhibitory effects on HBsAg, demonstrating superior performance compared to the positive control sequences.

(2) When the modified sequences are conjugated with GalNAc compounds, they can be efficiently delivered to the liver of animals, significantly inhibiting HBV gene expression and markedly reducing serum levels of HBsAg, HBeAg, and HBV DNA.

(3) The sequences modified using the modification templates of the present disclosure show significantly improved HBV inhibitory activity compared to sequences disclosed in the prior art that are relatively similar.

(4) The present disclosure finds that siRNAs with similar sequences can exhibit vastly different levels of activity.

(5) The present disclosure also finds that different sequences exhibit varying degrees of sensitivity to different modification templates. It is uncertain which modification template, when applied to an siRNA sequence, will result in high activity.

DETAILED DESCRIPTION OF THE PREFERRED EMBODIMENT

Figure 1A:
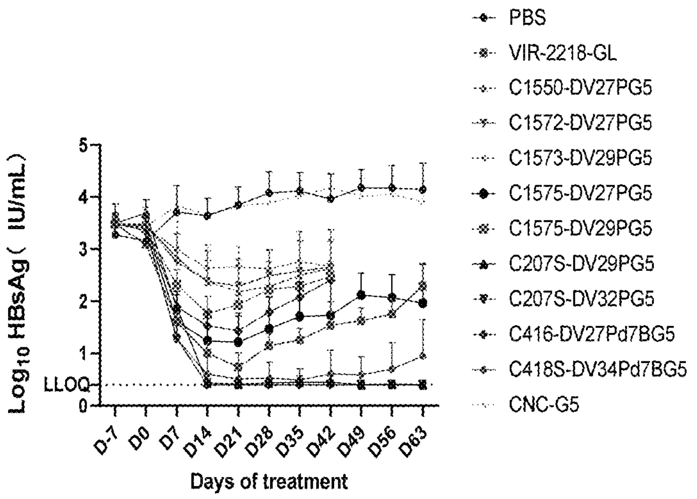
FIG. 1A shows serum HBsAg levels in AAV-HBV model mice at a dose of 3 mg/kg of the candidate siRNA sequence.

To make the present disclosure more easily understood, certain terms are first defined. Additionally, it should be noted that whenever a value or a range of values for a parameter is listed, the purpose is to indicate that intermediate values and ranges of these referenced values are also part of the present disclosure.

As used herein, the articles "a" and "an" refer to one or more (i.e., at least one) of the grammatical object of the article. By way of example, "an element" refers to one element or more than one elements, such as multiple elements.

The term "including" is used herein to mean the phrase "including but not limited to" and is used interchangeably with it.

The term "or" is used herein to mean the term "and/or" and is used interchangeably with it, unless the context clearly indicates otherwise.

As used herein, the terms "about" or "approximately," when applied to one or more target values, refer to values similar to the stated reference value. In some embodiments, unless otherwise stated or clearly evident from the context, the terms "approximately" or "about" refer to a range of values that fall within 20%, 19%, 18%, 17%, 16%, 15%, 14%, 13%, 12%, 11%, 10%, 9%, 8%, 7%, 6%, 5%, 4%, 3%, 2%, 1%, or less in either direction (greater or less than) of the stated reference value (unless such a number would exceed 100% of the possible value).

As used herein, "HBV" refers to hepatitis B virus, including genotypes A, B, C, D, E, F, G, H, I, J, and their subtypes, and is not limited to any specific genotype.

"G," "C," "A," and "U" each generally represent nucleotides containing guanine, cytosine, adenine, and uracil as their bases, respectively. "T" and "dT" are used interchangeably herein and refer to deoxyribonucleotides in which the nucleobase is thymine, such as deoxyribothymine, 2'-deoxythymidine, or thymidine. However, it should be understood that the terms "ribonucleotide," "nucleotide," or "deoxyribonucleotide" may also refer to a modified nucleotide (as further detailed below) or an alternative substituted moiety. Those skilled in the art will be well aware that guanine, cytosine, adenine, and uracil can be substituted by other moieties without substantially altering the base-pairing properties of an oligonucleotide (including a nucleotide containing such a substituted moiety). For example, but not limited to, a nucleotide containing inosine as its base can base-pair with nucleotides containing adenine, cytosine, or uracil. Thus, nucleotides containing uracil, guanine, or adenine may be substituted in the nucleotide sequences of the present disclosure by a nucleotide containing, for example, inosine. Sequences containing such substituted moieties are embodiments of the present disclosure.

The terms "RNAi agent" and "RNA interference agent" are used interchangeably herein and refer to RNA agents as defined herein, which mediate targeted cleavage of RNA transcripts through the RNA-induced silencing complex (RISC) pathway. RNAi agents guide sequence-specific degradation of mRNA through a process known as RNA interference (RNAi). RNAi agents regulate, for example, inhibit, the expression of HBV in cells, such as cells within a subject (e.g., a mammalian subject). RNAi molecules include single-stranded RNAi molecules, double-stranded siRNAs, and short hairpin RNAs (shRNAs).

The term "small interfering ribonucleic acid" or "siRNA" refers to small interfering ribonucleic acid RNAi molecules. It is a class of double-stranded RNA molecules, also known in the art as short interfering RNA or silencing RNA. siRNAs typically comprise a sense strand (also known as the passenger strand) and an antisense strand (also known as the guide strand), wherein each strand is 17 to 30 nucleotides in length, usually 19 to 25 nucleotides in length, wherein the antisense strand is complementary to the target nucleic acid (such as at least 95% complementary, such as fully complementary) (suitably a mature mRNA sequence), and the sense strand is complementary to the antisense strand, such that the sense and antisense strands form a duplex or duplex region. siRNA strands may form blunt-ended duplexes, or preferably, the 3' ends of the sense and antisense strands may form 3' overhangs, such as 1, 2, or 3 nucleotides, similar to the products produced by Dicer, which can form RISC substrates in vivo. Extended forms of Dicer substrates have been described in U.S. Pat. Nos. 8,349,809 and 8,513,207, which are incorporated herein by reference. In some embodiments, both the sense strand and the antisense strand have 3' overhangs of 2 nucleotides. Thus, the duplex region can be, for example, 17 to 25 nucleotides in length, such as 21 to 23 nucleotides in length.

The term “antisense strand” refers to the strand of RNAi (e.g., dsRNA) that includes a region substantially complementary to the target sequence. As used herein, the term “complementary region” refers to the region on the antisense strand that is substantially complementary to the sequence defined herein (e.g., the target sequence). When the complementary region is not fully complementary to the target sequence, mismatches can occur in the internal or terminal regions of the molecule. Typically, the most tolerated mismatches are in the terminal regions, for example, within 5, 4, 3, or 2 nucleotides at the 5' and/or 3' ends.

The term “sense strand” as used herein refers to the strand of RNAi that includes a region substantially complementary to the region of the antisense strand (as defined herein).

The term “inhibition” and its variants as used herein may be used interchangeably with “reduction,” “silencing,” “downregulation,” “suppression,” and other similar terms, and includes any level of inhibition.

As used herein, the phrase “inhibition of HBV gene expression” and its variants include inhibition of the expression of HBV DNA, HBV mRNA, HBsAg, HBeAg, hepatitis B core antigen (HBcAg), and the like.

“Inhibition of HBV antigen expression” and its variants include inhibition of the expression of HBsAg, HBeAg, and HBcAg proteins.

“Inhibition of HBV gene expression” and its variants include any level of inhibition of HBV DNA, HBV mRNA, HBsAg, HBeAg, and HBcAg, such as at least partial inhibition of the expression of HBV DNA, HBV mRNA, HBsAg, HBeAg, and HBcAg, for example, inhibition of at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99%.

Based on any variable level associated with HBV gene expression, such as HBV DNA levels, HBV mRNA levels, HBV antigen protein levels, or HBV viral particle levels, the expression of HBV genes can be assessed. Inhibition can be assessed by a reduction in the absolute or relative levels of one or more of these variables compared to control levels. Control levels can be any type of control level utilized in the field, such as pre-treatment baseline levels or levels determined from similar untreated or control-treated (e.g., buffer-only control or inert agent control) subjects, cells, or samples.

As used herein, “patient” or “subject” is intended to include humans or non-human animals, preferably mammals, such as mice. Most preferably, the subject or patient is a human.

As used herein, “disease associated with HBV gene expression” is intended to include any disease associated with HBV genes or proteins. Such diseases may result, for example, from excessive production of HBV antigen proteins, mutations in HBV genes, abnormal cleavage of HBV antigen proteins, or abnormal interactions between HBV antigen proteins and other proteins or endogenous or exogenous substances. Exemplary diseases associated with HBV gene expression include HBV infection-associated hepatitis, such as chronic hepatitis B, acute hepatitis B, as well as HBV/hepatitis D virus (HDV) co-infection and HBV/HIV co-infection-associated diseases.

As used herein, “therapeutically effective amount” is intended to include an amount of RNAi agent sufficient to achieve treatment of the disease (e.g., by mitigating, improving, or maintaining the existing disease or one or more disease symptoms) when administered to a patient for the treatment of a disease associated with HBV gene expression. The “therapeutically effective amount” may vary depending on the RNAi agent, how the agent is administered, the disease and its severity, medical history, age, weight, family history, genetic composition, the stage of the pathological process mediated by HBV expression, the type of prior or concomitant therapy (if any), and other individual characteristics of the patient to be treated.

As used herein, “prophylactically effective amount” is intended to include an amount of RNAi agent sufficient to prevent or ameliorate the disease or one or more symptoms of the disease when administered to a subject who has not yet experienced or shown symptoms of a disease associated with HBV gene expression but may be susceptible to it. To ameliorate the disease includes slowing the progression of the disease or reducing the severity of subsequent disease. The “prophylactically effective amount” may vary depending on the RNAi agent, how the agent is administered, the disease and its risk, medical history, age, weight, family history, genetic composition, the type of prior or concomitant therapy (if any), and other individual characteristics of the patient to be treated.

“Therapeutically effective amount” or “prophylactically effective amount” also includes an amount of RNAi agent that produces a desired local or systemic effect under a reasonable benefit/risk ratio applicable to any treatment. The RNAi agents used in the methods of the present disclosure may be administered in amounts sufficient to produce a reasonable benefit/risk ratio applicable to such treatments.

As used herein, the term “sample” includes fluids, cells, or tissues isolated from a subject, as well as a collection of fluids, cells, or tissues present within the subject. Examples of biological fluids include blood, serum, serous fluid, plasma, cerebrospinal fluid, ocular fluid, lymph, urine, saliva, and the like. Tissue samples may include samples from tissues, organs, or localized regions. For example, samples may be derived from specific organs, parts of organs, or fluids or cells within these organs. In some embodiments, samples may be derived from the liver (e.g., the entire liver or certain segments of the liver, or certain types of cells within the liver, such as hepatocytes). In preferred embodiments, a “sample derived from a subject” refers to blood or plasma drawn from the subject. In other embodiments, a “sample derived from a subject” refers to liver tissue (or its subcomponents) derived from the subject.

In one aspect, the present disclosure provides a double-stranded RNAi agent, wherein the double-stranded RNAi agent comprises an antisense strand and a sense strand complementary to the antisense strand forming a duplex region, wherein the nucleotide sequence of the antisense strand is as shown in SEQ ID NO: 8, 11, or 13, or the nucleotide sequence of the antisense strand is a modified sequence of the sequence shown in SEQ ID NO: 8, 11, or 13.

In some embodiments, the double-stranded RNAi agent comprises an oligonucleotide duplex formed by pairing of the sense strand and the antisense strand; wherein the sense strand has a sequence as shown in SEQ ID NO: 1, 4, or 6, or a fragment thereof, or a modified sequence of the sequence or fragment thereof.

In some embodiments, the sense strand and the antisense strand comprise at least one modified nucleotide.

In some embodiments, the double-stranded RNAi agent has the function of inhibiting HBV gene expression.

In some embodiments, at least one of the modified nucleotides is selected from one or more of the group consisting of: deoxy-nucleotide, 3'-terminal deoxy-thymidine nucleotide, 2'-O-methyl-modified nucleotide, 2'-fluoro-modified nucleotide, 2'-deoxy-modified nucleotide, locked nucleotide, unlocked nucleotide, conformationally restricted nucleotide, constrained ethyl nucleotide, abasic nucleotide, 2'-amino-modified nucleotide, 2'-O-allyl-modified nucleotide, 2'-C-alkyl-modified nucleotide, 2'-hydroxy-modified nucleotide, 2'-O-methoxyethyl-modified nucleotide, 2'-O-alkyl-modified nucleotide, morpholino nucleotide, phosphoramidate, nucleotide containing unnatural bases, tetrahydropyran-modified nucleotide, 1,5-anhydrohexitol-modified nucleotide, cyclohexenyl-modified nucleotide, nucleotide containing phosphorothioate groups, nucleotide containing methylphosphonate groups, nucleotide containing 5'-phosphate, and nucleotide containing 5'-phosphate mimetics.

In some embodiments, at least one strand of the double-stranded RNAi agent comprises a 3' overhang of at least 2 nucleotides.

In some embodiments, the duplex region of the double-stranded RNAi agent is 20 nucleotide pairs in length.

In some embodiments, the sense strand of the double-stranded RNAi agent has 20 nucleotides, and the antisense strand has 22 nucleotides.

In some embodiments, all modifications on the nucleotides of the sense and antisense strands are chemical modifications at the 2' position of the nucleotide ribose.

In some embodiments, the chemical modifications at the 2' position of the nucleotide ribose are selected from one or more of the group consisting of: 2'-methoxy, 2'-O-methoxyethyl, 2'-fluoro, 2'-benzyloxy, 2'-methylcarbonylamino, and 2'-pyridylmethoxy.

In some embodiments, the chemical modification at the 2' position of the nucleotide ribose is 2'-methoxy or 2'-fluoro.

In some embodiments, the nucleotides are linked by 3',5'-phosphodiester bonds.

In some embodiments, the 3',5'-phosphodiester bond comprises a phosphorothioate modification.

In some embodiments, a 5' carbon atom of the 5' terminal nucleotide glycoside of the antisense strand is phosphorylated.

In some embodiments, the phosphorylated 5' phosphorylated group includes one or more selected from: 5'-vinylphosphonate group, 5'-methylphosphonate group, 5'-C-methylphosphate group, 5'-phosphorothioate group, and 5'-phosphate group, with the structure being;

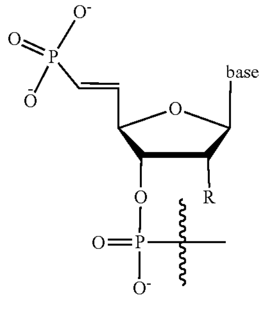

5'-(E)-vinylphosphonate
(5'-(E)-VP)

-continued

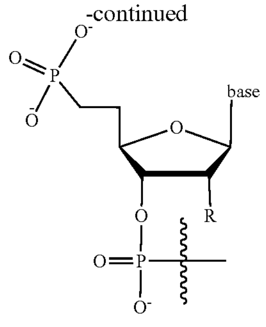

5'-methylphosphonate
(5'-MP)

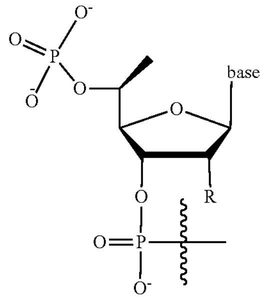

(S)-5'-C-methylphosphate

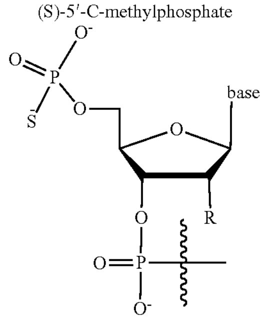

5'-phosphorothioate
(5'-PS)

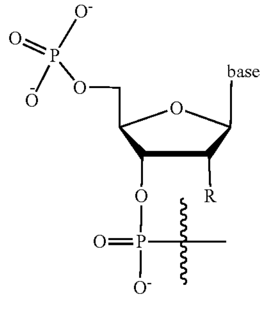

5'-phosphate
(5'-P)

R is hydrogen, hydroxyl, amino, $C_{1-4}$ alkyl, aryl, $C_{1-4}$ alkoxy, $C_{1-4}$ alkylcarbonylamino, or halogen;

the base is selected from any one of adenine, guanine, cytosine, thymine, and uracil.

In some embodiments, terminal nucleotides of the sequence are linked by a 3',5'-phosphodiester bond containing a phosphorothioate modification, forming a chirally pure 3',5'-phosphorothioate bond.

In some embodiments, a 5' end of the sense strand and the antisense strand comprises 1 to 3 phosphorothioate linkages, and a 3' end of the antisense strand comprises 1 to 3 phosphorothioate linkages.

In some embodiments, the antisense strand adopts one of the modification patterns outlined in the table below:

| | Antisense strand (AS) 5'-3' | | | | | | | | | | |
|---|---|---|---|---|---|---|---|---|---|---|---|
| No. | 1 | 2 | 3 | 4 | 5 | 6 | 7 | 8 | 9 | 10 | 11 |
| A | 2'-OMe + PS + EVP | 2'-F + PS | 2'-OMe | 2'-F | 2'-F | 2'-F | 2'-OMe | 2'-OMe | 2'-OMe | 2'-OMe | 2'-OMe |
| B | 2'-OMe + PS + EVP | 2'-F + PS | 2'-F | 2'-F | 2'-OMe | 2'-F | 2'-OMe | 2'-OMe | 2'-OMe | 2'-OMe | 2'-OMe |
| C | 2'-OMe + PS + EVP | 2'-F + PS | 2'-OMe | 2'-OMe | 2'-F | 2'-F | 2'-OMe | 2'-OMe | 2'-OMe | 2'-OMe | 2'-OMe |
| D | 2'-OMe + PS + EVP | 2'-F + PS | 2'-F | 2'-OMe | 2'-OMe | 2'-F | 2'-OMe | 2'-OMe | 2'-OMe | 2'-OMe | 2'-OMe |
| E | 2'-OMe + PS + EVP | 2'-F + PS | 2'-OMe | 2'-OMe | 2'-OMe | 2'-F | 2'-OMe | 2'-OMe | 2'-OMe | 2'-OMe | 2'-OMe |
| F | 2'-OMe + PS + EVP | 2'-F + PS | 2'-F | 2'-OMe | 2'-F | 2'-F | 2'-OMe | 2'-OMe | 2'-OMe | 2'-OMe | 2'-OMe |

| | Antisense strand (AS) 5'-3' | | | | | | | | | | |
|---|---|---|---|---|---|---|---|---|---|---|---|
| No. | 12 | 13 | 14 | 15 | 16 | 17 | 18 | 19 | 20 | 21 | 22 |
| A | 2'-OMe | 2'-OMe | 2'-F | 2'-OMe | 2'-F | 2'-OMe | 2'-OMe | 2'-OMe | 2'-OMe + PS | 2'-OMe + PS | 2'-OMe |
| B | 2'-OMe | 2'-OMe | 2'-F | 2'-OMe | 2'-F | 2'-OMe | 2'-OMe | 2'-OMe | 2'-OMe + PS | 2'-OMe + PS | 2'-OMe |
| C | 2'-OMe | 2'-OMe | 2'-F | 2'-OMe | 2'-F | 2'-OMe | 2'-OMe | 2'-OMe | 2'-OMe + PS | 2'-OMe + PS | 2'-OMe |
| D | 2'-OMe | 2'-OMe | 2'-F | 2'-OMe | 2'-F | 2'-OMe | 2'-OMe | 2'-OMe | 2'-OMe + PS | 2'-OMe + PS | 2'-OMe |
| E | 2'-OMe | 2'-OMe | 2'-F | 2'-OMe | 2'-F | 2'-OMe | 2'-OMe | 2'-OMe | 2'-OMe + PS | 2'-OMe + PS | 2'-OMe |
| F | 2'-OMe | 2'-OMe | 2'-F | 2'-OMe | 2'-F | 2'-OMe | 2'-OMe | 2'-OMe | 2'-OMe + PS | 2'-OMe + PS | 2'-OMe ; or |

| | Antisense strand (AS) 5'-3' | | | | | | | | | | | |
|---|---|---|---|---|---|---|---|---|---|---|---|---|
| No. | 1 | 2 | 3 | 4 | 5 | 6 | 7 | 8 | 9 | 10 | 11 | 12 |
| A | 2'-OMe + PS + EVP | 2'-F + PS | 2'-OMe | 2'-F | 2'-F | 2'-F | 2'-OMe | 2'-OMe | 2'-OMe | 2'-OMe | 2'-OMe | 2'-OMe |
| B | 2'-OMe + PS + EVP | 2'-F + PS | 2'-F | 2'-F | 2'-OMe | 2'-F | 2'-OMe | 2'-OMe | 2'-OMe | 2'-OMe | 2'-OMe | 2'-OMe |
| C | 2'-OMe + PS + EVP | 2'-F + PS | 2'-OMe | 2'-OMe | 2'-F | 2'-F | 2'-OMe | 2'-OMe | 2'-OMe | 2'-OMe | 2'-OMe | 2'-OMe |
| D | 2'-OMe + PS + EVP | 2'-F + PS | 2'-F | 2'-OMe | 2'-OMe | 2'-F | 2'-OMe | 2'-OMe | 2'-OMe | 2'-OMe | 2'-OMe | 2'-OMe |
| E | 2'-OMe + PS + EVP | 2'-F + PS | 2'-OMe | 2'-OMe | 2'-OMe | 2'-F | 2'-OMe | 2'-OMe | 2'-OMe | 2'-OMe | 2'-OMe | 2'-OMe |
| F | 2'-OMe + PS + EVP | 2'-F + PS | 2'-F | 2'-OMe | 2'-F | 2'-F | 2'-OMe | 2'-OMe | 2'-OMe | 2'-OMe | 2'-OMe | 2'-OMe |

| | Antisense strand (AS) 5'-3' | | | | | | | | | | |
|---|---|---|---|---|---|---|---|---|---|---|---|
| No. | 13 | 14 | 15 | 16 | 17 | 18 | 19 | 20 | 21 | 22 | 23 |
| A | 2'-OMe | 2'-F | 2'-OMe | 2'-F | 2'-OMe | 2'-OMe | 2'-OMe | 2'-OMe | 2'-OMe + PS | 2'-OMe + PS | 2'-OMe |
| B | 2'-OMe | 2'-F | 2'-OMe | 2'-F | 2'-OMe | 2'-OMe | 2'-OMe | 2'-OMe | 2'-OMe + PS | 2'-OMe + PS | 2'-OMe |
| C | 2'-OMe | 2'-F | 2'-OMe | 2'-F | 2'-OMe | 2'-OMe | 2'-OMe | 2'-OMe | 2'-OMe + PS | 2'-OMe + PS | 2'-OMe |
| D | 2'-OMe | 2'-F | 2'-OMe | 2'-F | 2'-OMe | 2'-OMe | 2'-OMe | 2'-OMe | 2'-OMe + PS | 2'-OMe + PS | 2'-OMe |
| E | 2'-OMe | 2'-F | 2'-OMe | 2'-F | 2'-OMe | 2'-OMe | 2'-OMe | 2'-OMe | 2'-OMe + PS | 2'-OMe + PS | 2'-OMe |
| F | 2'-OMe | 2'-F | 2'-OMe | 2'-F | 2'-OMe | 2'-OMe | 2'-OMe | 2'-OMe | 2'-OMe + PS | 2'-OMe + PS | 2'-OMe |

and/or, the sense strand adopts one of the modification patterns outlined in the table below:

| | Sense strand (SS) 5'-3' | | | | | | | | | |
|---|---|---|---|---|---|---|---|---|---|---|
| No. | 1 | 2 | 3 | 4 | 5 | 6 | 7 | 8 | 9 | 10 |
| a | 2'-OMe + PS | 2'-OMe + PS | 2'-OMe | 2'-OMe | 2'-OMe | 2'-F | 2'-OMe | 2'-F | 2'-F | 2'-F |
| b | 2'-OMe + PS | 2'-OMe + PS | 2'-OMe | 2'-OMe | 2'-OMe | 2'-F | 2'-OMe | 2'-F | 2'-OMe | 2'-F |

| | Sense strand (SS) 5'-3' | | | | | | | | | |
|---|---|---|---|---|---|---|---|---|---|---|
| No. | 11 | 12 | 13 | 14 | 15 | 16 | 17 | 18 | 19 | 20 |
| a | 2'-OMe | 2'-OMe | 2'-OMe | 2'-OMe | 2'-OMe | 2'-F | 2'-OMe | 2'-OMe | 2'-OMe | 2'-OMe |
| b | 2'-OMe | 2'-OMe | 2'-OMe | 2'-OMe | 2'-OMe | 2'-F | 2'-OMe | 2'-OMe | 2'-OMe | 2'-OMe ; |

| | Sense strand (SS) 5'-3' | | | | | | | | | | |
|---|---|---|---|---|---|---|---|---|---|---|---|
| No. | 1 | 2 | 3 | 4 | 5 | 6 | 7 | 8 | 9 | 10 | 11 |
| a | 2'-OMe + PS | 2'-OMe + PS | 2'-OMe | 2'-OMe | 2'-OMe | 2'-OMe | 2'-F | 2'-OMe | 2'-F | 2'-F | 2'-F |
| b | 2'-OMe + PS | 2'-OMe + PS | 2'-OMe | 2'-OMe | 2'-OMe | 2'-OMe | 2'-F | 2'-OMe | 2'-F | 2'-OMe | 2'-F |

-continued

| | Sense strand (SS) 5'-3' | | | | | | | | | |
|---|---|---|---|---|---|---|---|---|---|---|
| No. | 12 | 13 | 14 | 15 | 16 | 17 | 18 | 19 | 20 | 21 |
| a | 2'-OMe | 2'-OMe | 2'-OMe | 2'-OMe | 2'-OMe | 2'-F | 2'-OMe | 2'-OMe | 2'-OMe | 2'-OMe |
| b | 2'-OMe | 2'-OMe | 2'-OMe | 2'-OMe | 2'-OMe | 2'-F | 2'-OMe | 2'-OMe | 2'-OMe | 2'-OMe |

wherein 2'-OMe is 2'-methoxy; 2'-F is 2'-fluoro; PS is phosphorothioate backbone; EVP is 5'-(E)-vinylphosphonate.

In some embodiments, the modification patterns of the double-stranded RNAi agent are as follows:

the siRNA modification template with antisense strand modified by pattern A and sense strand modified by pattern a is designated as DV27P;

the siRNA modification template with antisense strand modified by pattern A and sense strand modified by pattern b is designated as DV29P;

the siRNA modification template with antisense strand modified by pattern B and sense strand modified by pattern a is designated as DV26P;

the siRNA modification template with antisense strand modified by pattern B and sense strand modified by pattern b is designated as DV28P;

the siRNA modification template with antisense strand modified by pattern C and sense strand modified by pattern b is designated as DV32P;

the siRNA modification template with antisense strand modified by pattern D and sense strand modified by pattern b is designated as DV34P;

the siRNA modification template with antisense strand modified by pattern E and sense strand modified by pattern a is designated as DV25P; or the siRNA modification template with antisense strand modified by pattern F and sense strand modified by pattern b is designated as DV33P.

In some embodiments, the antisense strand is modified with modifying groups from the second to the eighth positions starting from the 5' end, wherein the modifying groups are selected from one or more of UNA, GNA, and DNA, and the structures of UNA and GNA are

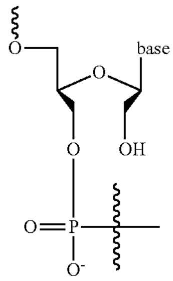

Unlocked nucleic acid (UNA)

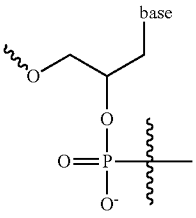

;

Glycol nucleic acid (GNA)

the base is selected from any one of adenine, guanine, cytosine, thymine, and uracil.

In some embodiments, the double-stranded RNAi agent comprises an oligonucleotide duplex selected from any one of the following sense and antisense strand pairs:

(1) the sense strand has the sequence as shown in SEQ ID NO: 81, and the antisense strand has the sequence as shown in SEQ ID NO: 179, 180, 181, 182, or 184;

(2) the sense strand has the sequence as shown in SEQ ID NO: 82, and the antisense strand has the sequence as shown in SEQ ID NO: 179, 180, or 183;

(3) the sense strand has the sequence as shown in SEQ ID NO: 83, and the antisense strand has the sequence as shown in SEQ ID NO: 185 or 186;

(4) the sense strand has the sequence as shown in SEQ ID NO: 84, and the antisense strand has the sequence as shown in SEQ ID NO: 186;

(5) the sense strand has the sequence as shown in SEQ ID NO: 85, and the antisense strand has the sequence as shown in SEQ ID NO: 186;

(6) the sense strand has the sequence as shown in SEQ ID NO: 96, and the antisense strand has the sequence as shown in SEQ ID NO: 201, 202, 203, or 204;

(7) the sense strand has the sequence as shown in SEQ ID NO: 97, and the antisense strand has the sequence as shown in SEQ ID NO: 201 or 202;

(8) the sense strand has the sequence as shown in SEQ ID NO: 98, and the antisense strand has the sequence as shown in SEQ ID NO: 205 or 206;

(9) the sense strand has the sequence as shown in SEQ ID NO: 99, and the antisense strand has the sequence as shown in SEQ ID NO: 206;

(10) the sense strand has the sequence as shown in SEQ ID NO: 100, and the antisense strand has the sequence as shown in SEQ ID NO: 206;

(11) the sense strand has the sequence as shown in SEQ ID NO: 106, and the antisense strand has the sequence as shown in SEQ ID NO: 213, 214, 215, or 216;

(12) the sense strand has the sequence as shown in SEQ ID NO: 107, and the antisense strand has the sequence as shown in SEQ ID NO: 214 or 213;

(13) the sense strand has the sequence as shown in SEQ ID NO: 108, and the antisense strand has the sequence as shown in SEQ ID NO: 217 or 218;

(14) the sense strand has the sequence as shown in SEQ ID NO: 109, and the antisense strand has the sequence as shown in SEQ ID NO: 218;

(15) the sense strand has the sequence as shown in SEQ ID NO: 110, and the antisense strand has the sequence as shown in SEQ ID NO: 218;

(16) the sense strand has the sequence as shown in SEQ ID NO: 306, and the antisense strand has the sequence as shown in SEQ ID NO: 321.

The double-stranded RNA (dsRNA) agent (double-stranded RNAi agent) of the present disclosure may optionally be conjugated to one or more ligands. The ligand may be attached to the sense strand, the antisense strand, or both strands at the 3' end, the 5' end, or both ends. For example, the ligand may be conjugated to the sense strand. In a preferred embodiment, the ligand is attached to the 3' end of the sense strand. In one preferred embodiment, the ligand is a GalNAc ligand.

In another aspect, the present disclosure provides a conjugate comprising the aforementioned double-stranded RNAi agent and a ligand conjugated to the double-stranded RNAi agent.

In some embodiments, the ligand is conjugated to a 3'-end or a 5'-end of an oligonucleotide sense strand.

In some embodiments, the ligand is one or more GalNAc derivatives attached via a bivalent or trivalent branched linker, or a GalNAc derivative attached via a monovalent linker.

In some embodiments, the ligand is

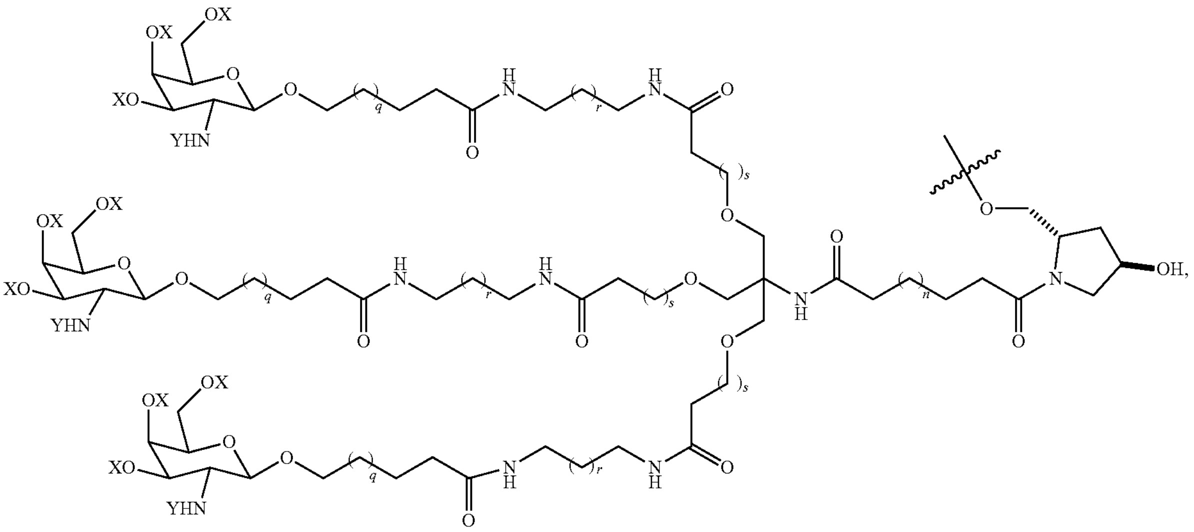

wherein X is hydrogen, a hydroxyl protecting group, or H, and the hydroxyl protecting group includes acetyl, benzoyl, or isobutyryl; Y is an amine protecting group or H, and the amine protecting group is formyl, acetyl, propionyl, n-butyryl, or isobutyryl; n is an integer between 0 and 20; q, r, and s are independently integers between 1 and 7.

In some embodiments, the ligand is

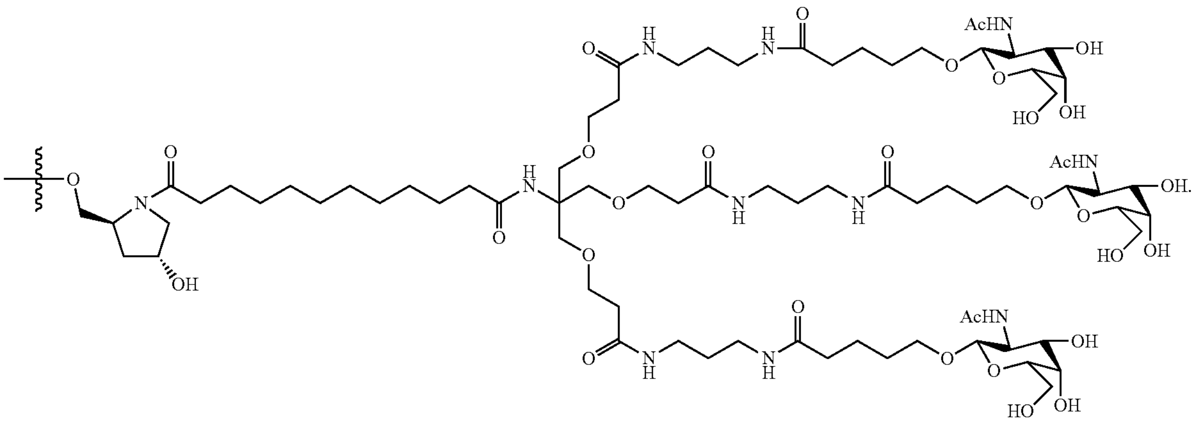

In some embodiments, the ligand is

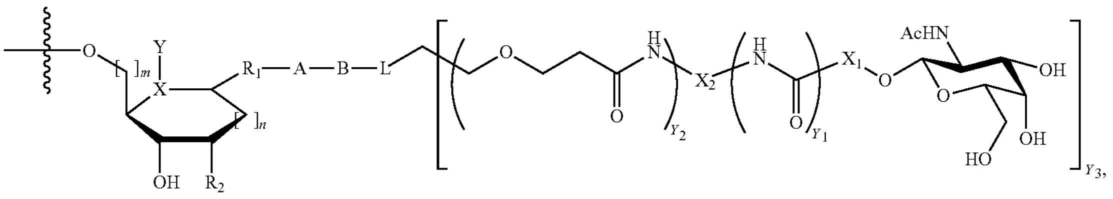

wherein X is oxygen, nitrogen, or sulfur;

Y is an alkyl or aromatic group;

$R_1$ is oxygen or sulfur;

$R_2$ is hydrogen, an amino group, a $C_{1-4}$ alkyl group, an aromatic group, a $C_{1-4}$ alkoxy group, or a halogen;

A is $-(CH_2)_a-$, $-(CH_2CH_2O)_b-$, $-((CH_2)_cNHCO)_d-$, or $-((CH_2)_cCONH)_d-$, where a is an integer from 1 to 15, b is an integer from 1 to 7, c is an integer from 1 to 7, and d is an integer from 1 to 5;

B is $-(CH_2)_e-$, where e is an integer from 0 to 7;

L is —CONH— or —NHCO—;

$X_1$ is $-(CH_2)_f-$ or $-(CH_2CH_2O)_fCH_2-$, where f is an integer from 1 to 5;

$X_2$ is $-(CH_2)_g$, where g is an integer from 1 to 6, $Y_1$ is 0 or 1, $Y_2$ is 0, 1, or 2, $Y_3$ is 1, 2, or 3, m is an integer from 0 to 4, n is an integer from 0 to 4.

In some embodiments, the ligand is G4, G5, G6, or G7:

G4

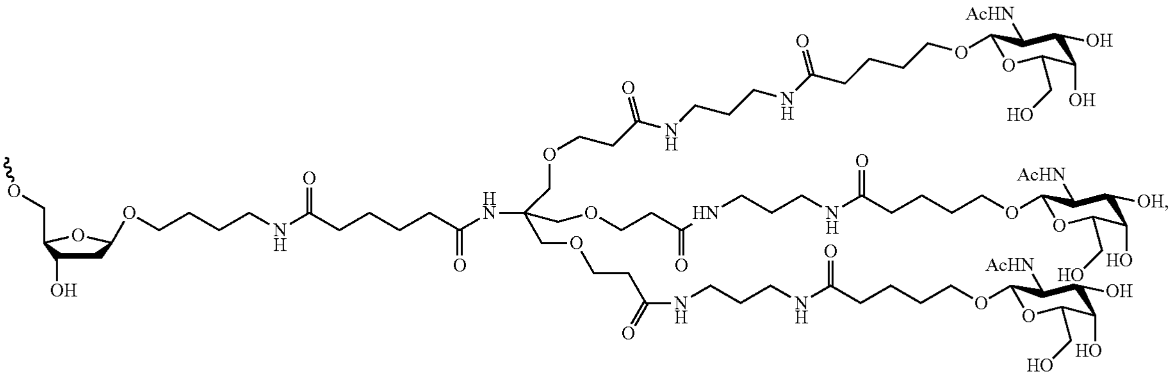

G5

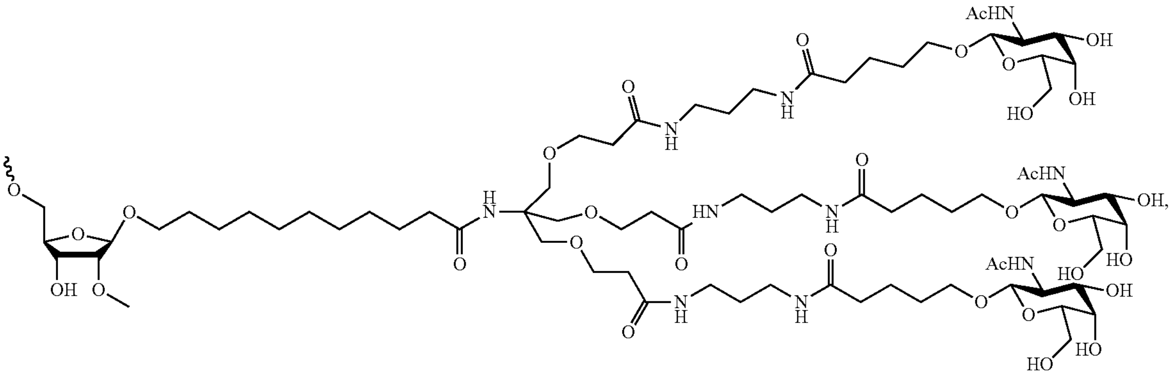

-continued
G6
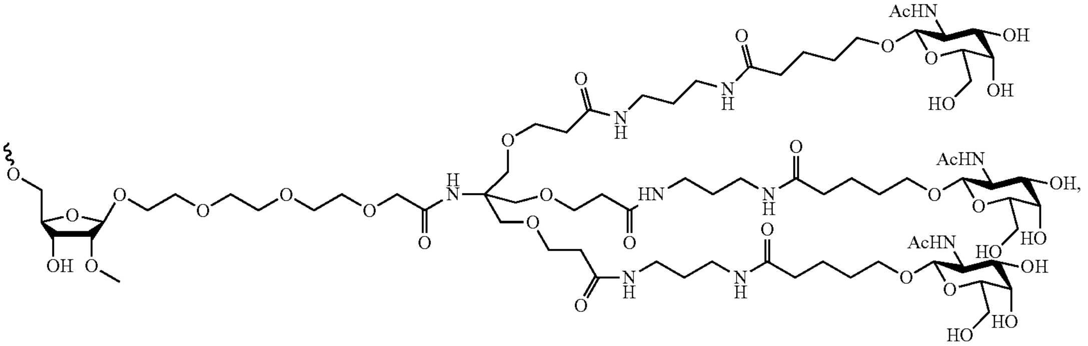
or
G7
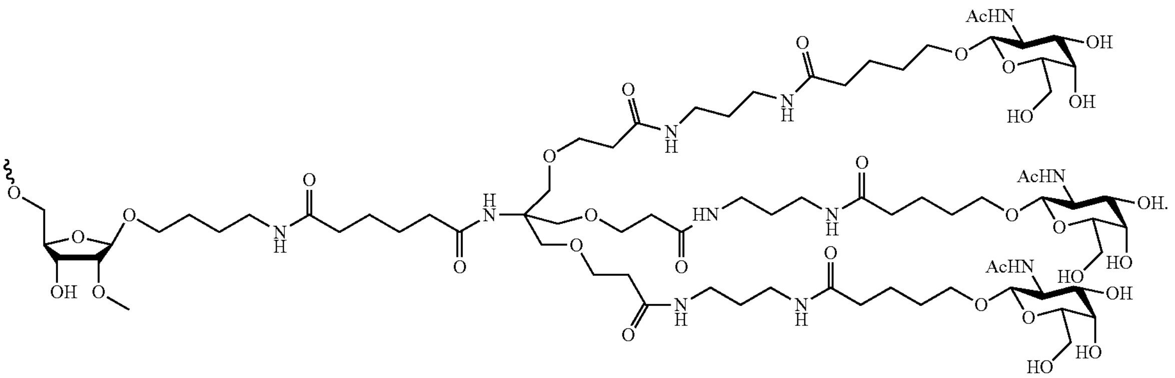
In some embodiments, the ligand is represented by the following structures:
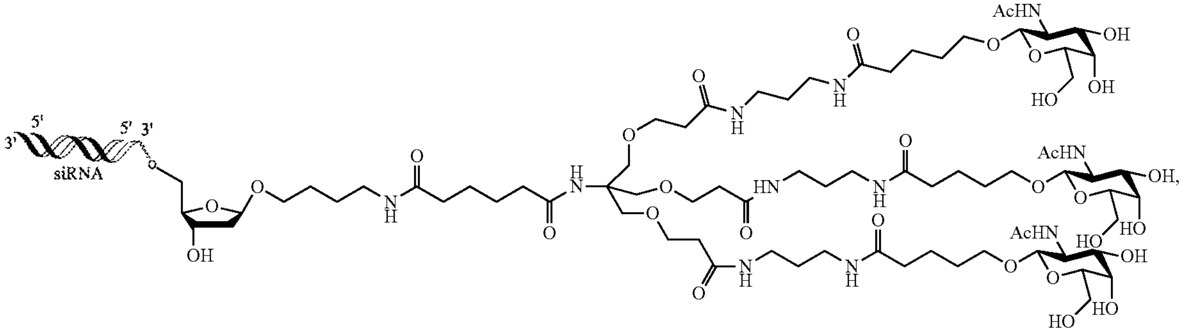
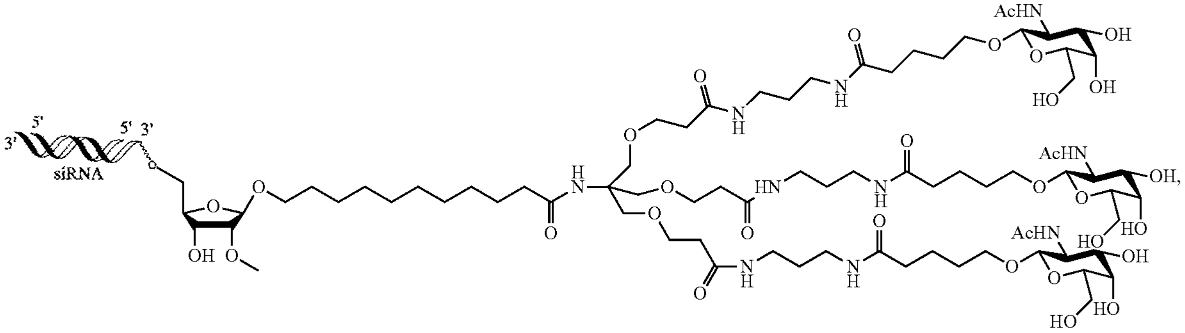

-continued
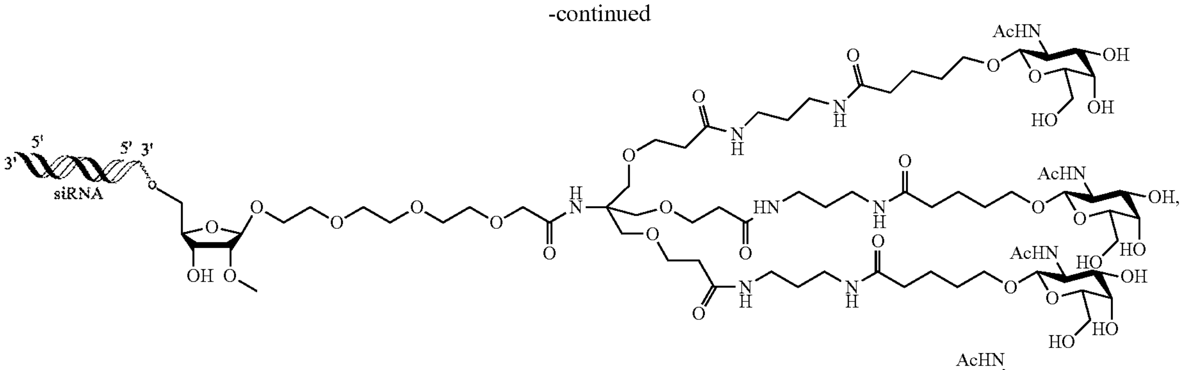
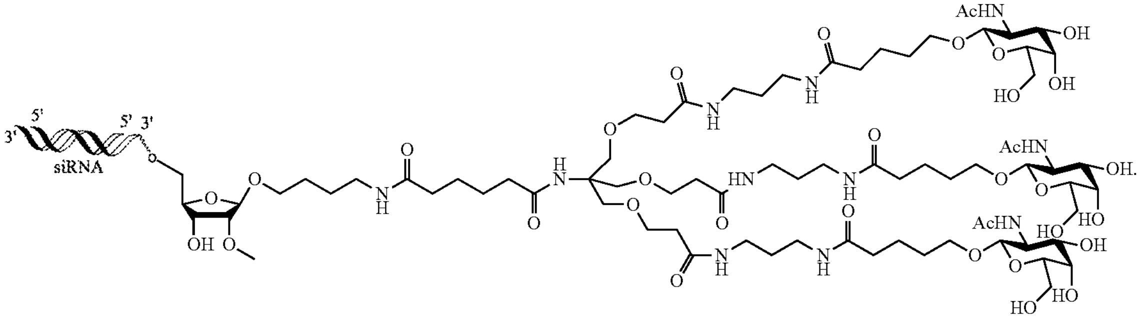
or
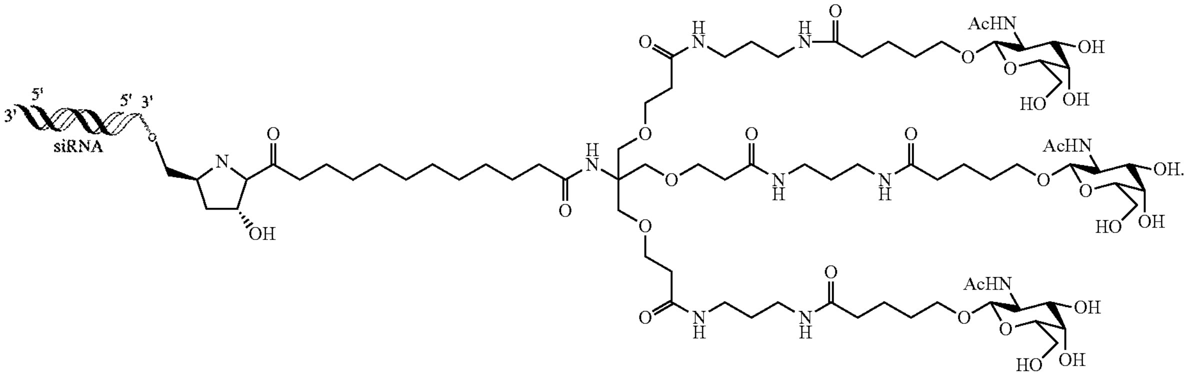
In some embodiments, the ligand is:
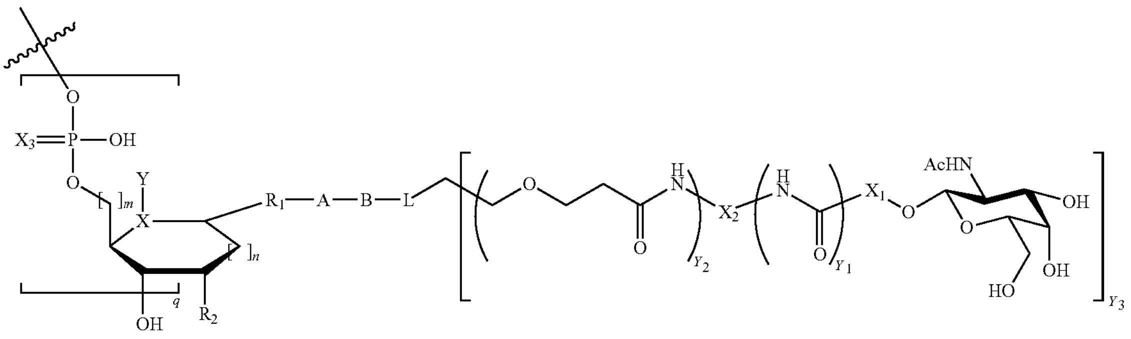

wherein X is oxygen, nitrogen, or sulfur;

Y is an alkyl or aromatic group;

$R_1$ is oxygen or sulfur;

$R_2$ is hydrogen, an amino group, a $C_{1-4}$ alkyl group, an aromatic group, a $C_{1-4}$ alkoxy group, or a halogen;

A is $-(CH_2)_a-$, $-(CH_2CH_2O)_b-$, $-((CH_2)_cNHCO)_d-$, or $-((CH_2)_cCONH)_d-$, where a is an integer from 1 to 15, b is an integer from 1 to 7, c is an integer from 1 to 7, and d is an integer from 1 to 5;

B is $-(CH_2)_e-$, where e is an integer from 0 to 7;

L is —CONH— or —NHCO—;

$X_1$ is $-(CH_2)_f-$ or $-(CH_2CH_2O)_fCH_2-$, where f is an integer from 1 to 5;

$X_2$ is $-(CH_2)_g-$, where g is an integer from 1 to 6;

$Y_1$ is 0 or 1;

$Y_2$ is 0, 1, or 2;

$Y_3$ is 1, 2, or 3;

m is an integer from 0 to 4;

n is an integer from 0 to 4.

In some embodiments, the ligand is G101, G102, G103, G105, or G106:

G101

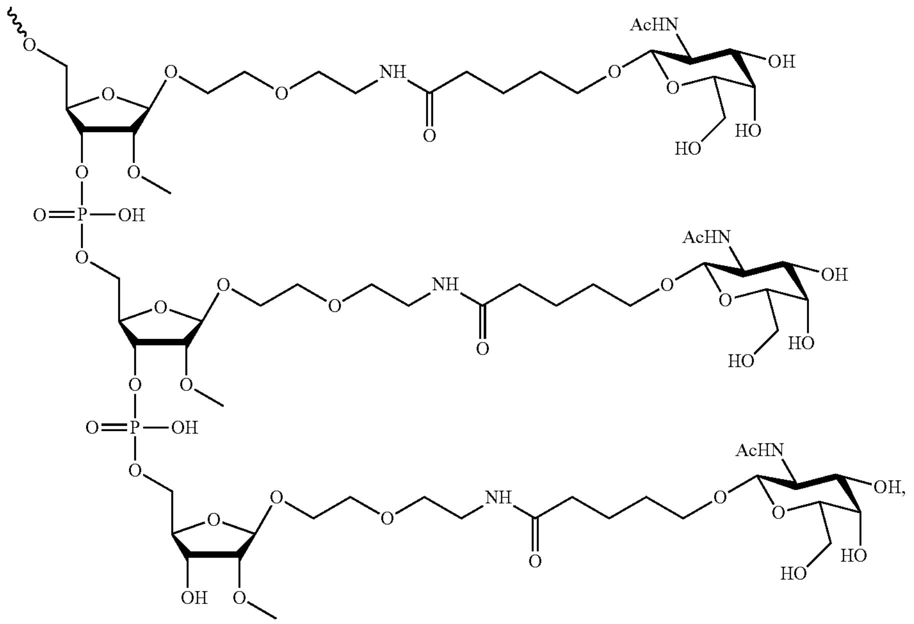

G102

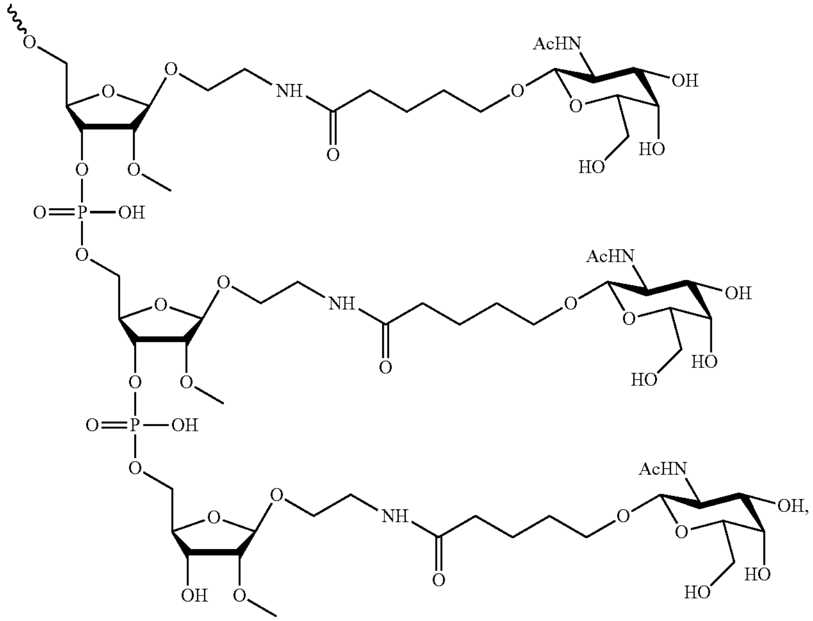

-continued
G103
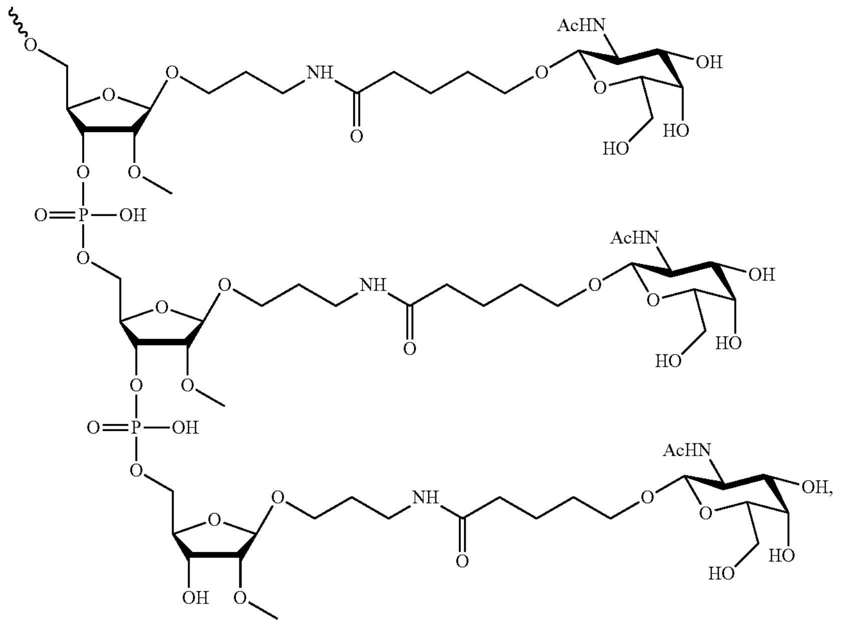
G105
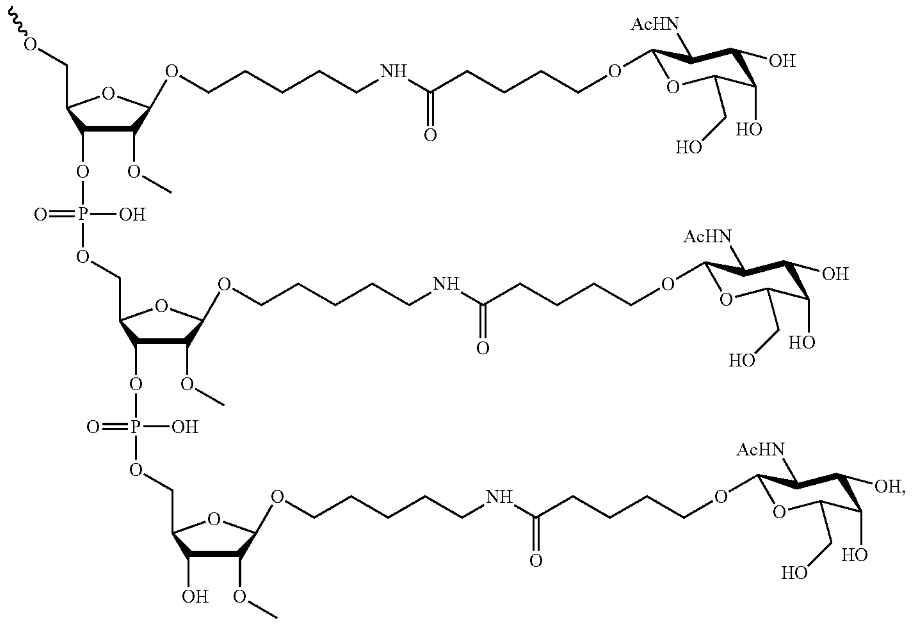
or

-continued
G106
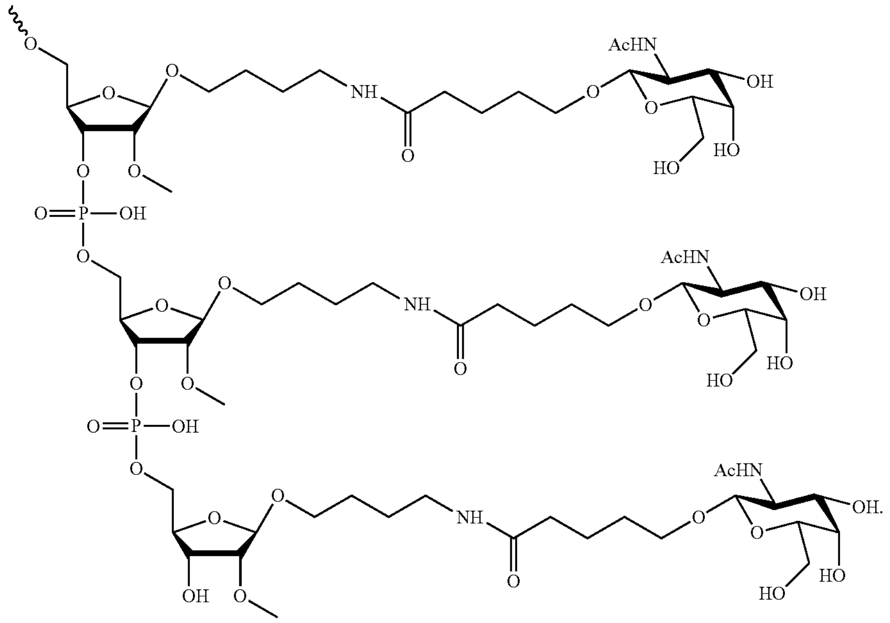
In some embodiments, the ligand is represented by the following structures:
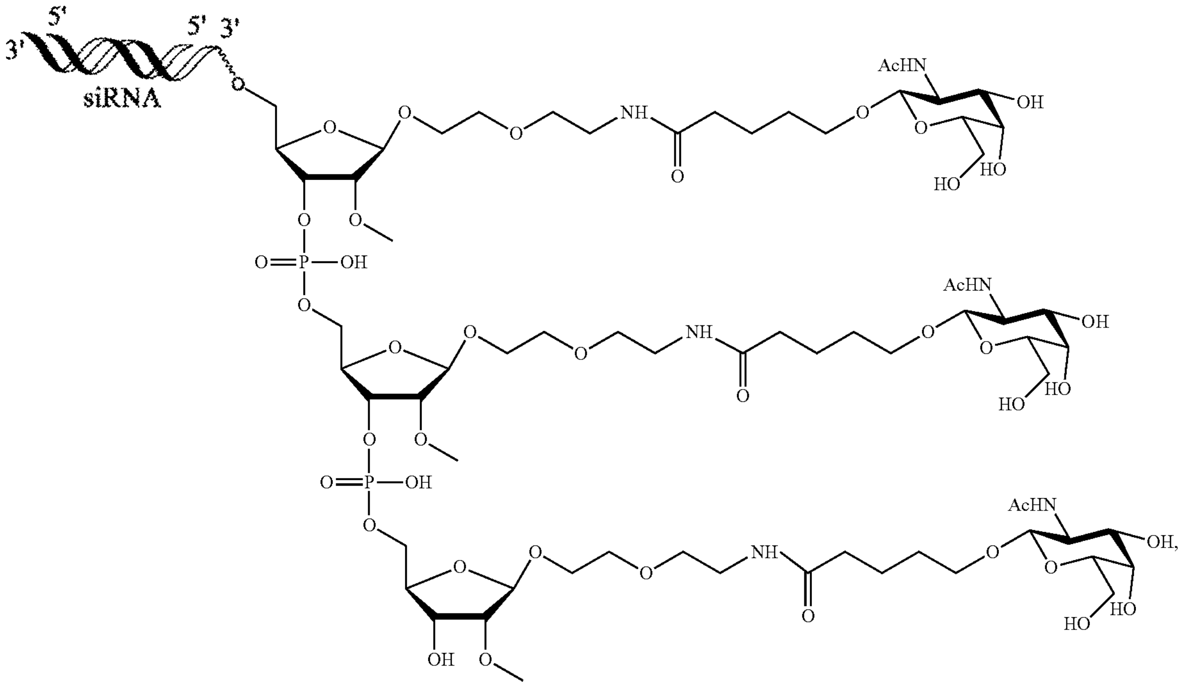

-continued
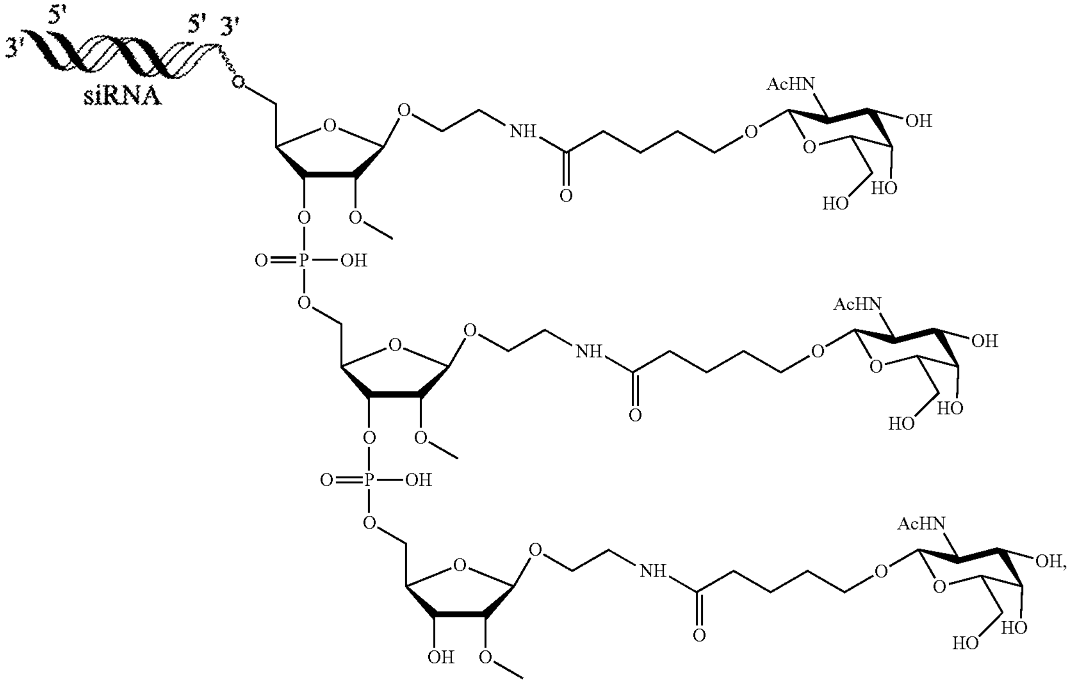
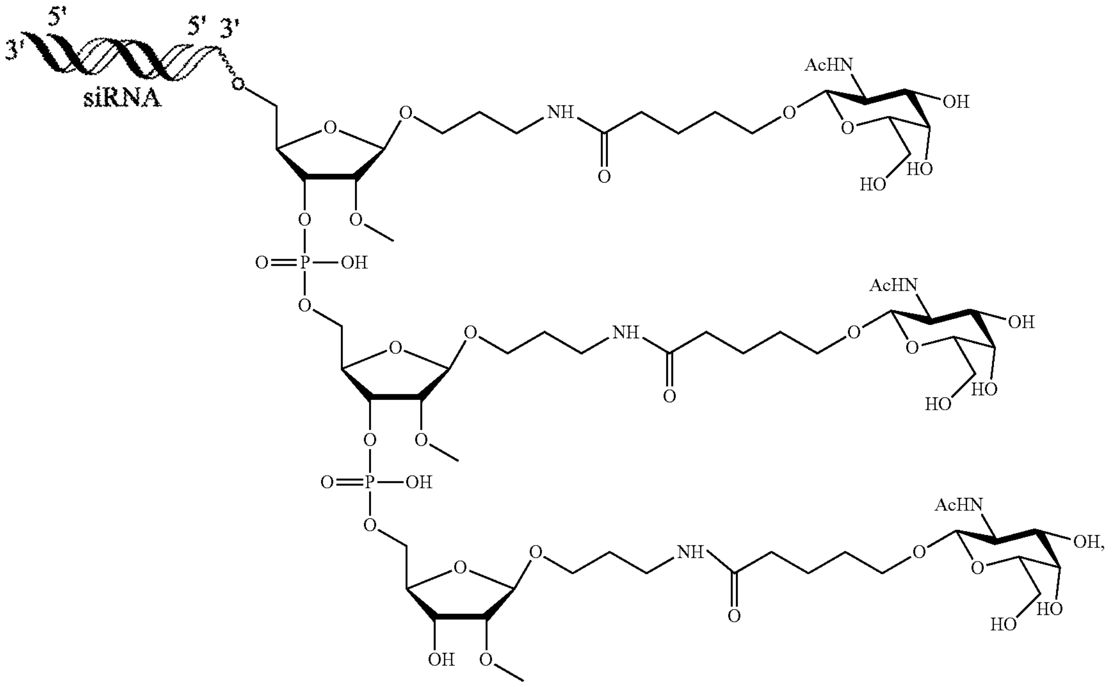

-continued

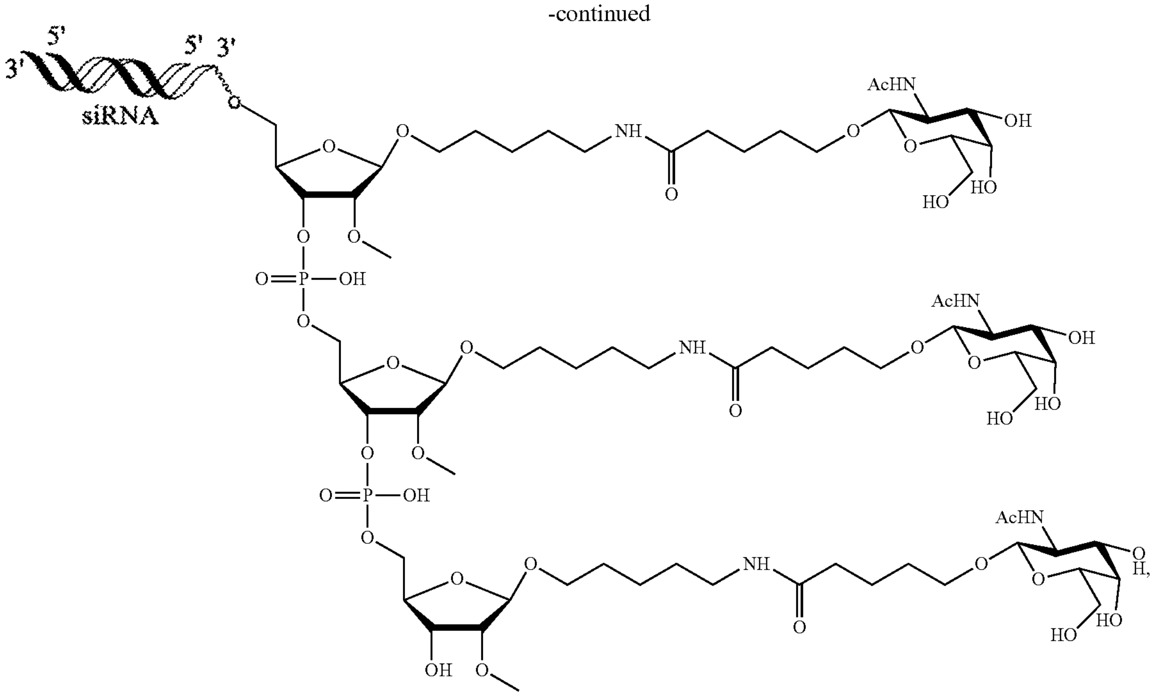

or

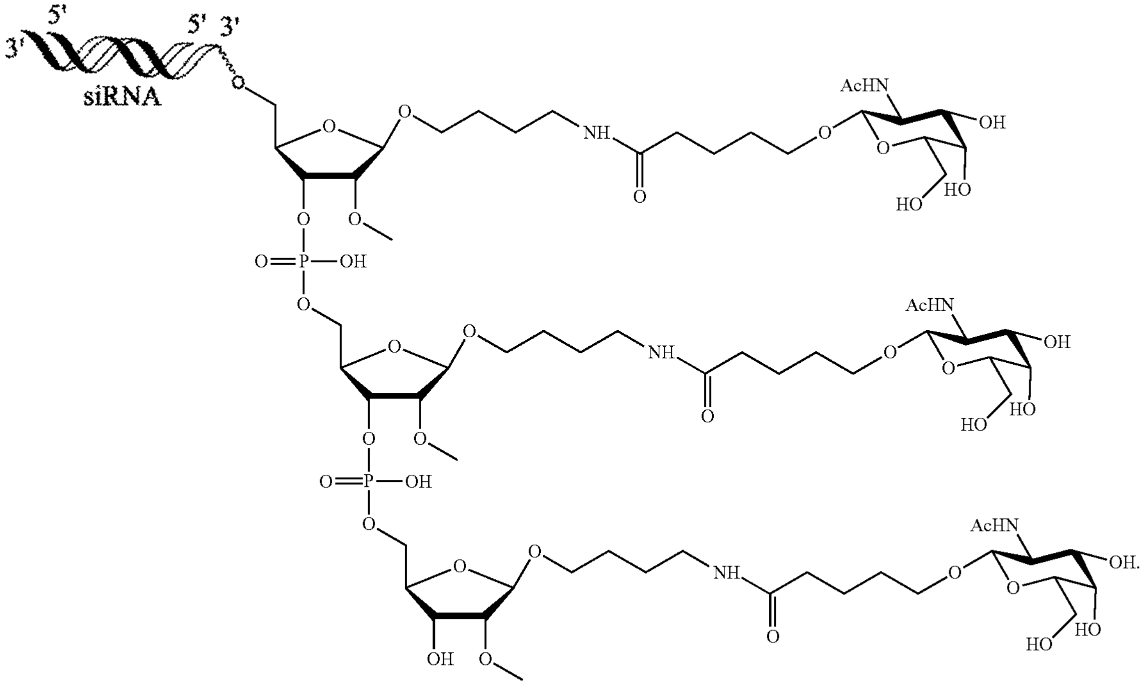

In some embodiments, the conjugate comprises an oligonucleotide duplex selected from any one of the following sense and antisense strand pairs:

(1) the sense strand has the sequence as shown in SEQ ID NO: 326, 327 or 328, and the antisense strand has the sequence as shown in SEQ ID NO: 179;

(2) the sense strand has the sequence as shown in SEQ ID NO: 329, 330 or 331, and the antisense strand has the sequence as shown in SEQ ID NO: 181;

(3) the sense strand has the sequence as shown in SEQ ID NO: 338 or 341, and the antisense strand has the sequence as shown in SEQ ID NO: 201;

(4) the sense strand has the sequence as shown in SEQ ID NO: 350, 351 or 352, and the antisense strand has the sequence as shown in SEQ ID NO: 321.

In some embodiments, the conjugate has the function of inhibiting HBV gene expression.

In another aspect, the present disclosure provides a pharmaceutical composition comprising the aforementioned double-stranded RNAi agent or the aforementioned conjugate, along with a pharmaceutically acceptable carrier.

In one embodiment, the present disclosure provides a pharmaceutical composition comprising the double-stranded RNAi agent as described herein and a pharmaceutically acceptable carrier. The pharmaceutical composition comprising the double-stranded RNAi agent can be used to treat diseases or disorders associated with the expression or activity of HBV genes, such as chronic hepatitis B. Such pharmaceutical compositions are formulated based on delivery models. One example is a composition formulated for systemic administration via parenteral delivery, such as intravenous (IV) delivery. Another example is a composition formulated for direct delivery to the brain parenchyma, such as through infusion into the brain, for example, via continuous pump infusion.

The pharmaceutical composition comprising the double-stranded RNAi agent of the present disclosure may be, for example, a solution with or without a buffer or a composition comprising a pharmaceutically acceptable carrier. Such compositions include, for example, aqueous or crystalline compositions, liposome formulations, micelle formulations, emulsions, and gene therapy vectors.

In the method of the present disclosure, the double-stranded RNAi agent may be administered in a solution. A free double-stranded RNAi agent may be administered in a non-buffered solution, such as in normal saline or in water. Alternatively, the free siRNA may also be administered in a suitable buffered solution. The buffered solution may include acetate, citrate, prolamine, carbonate, or phosphate, or any combination thereof. In a preferred embodiment, the buffered solution is phosphate-buffered saline (PBS). The pH and osmolarity of the buffered solution comprising the double-stranded RNAi agent may be adjusted to make it suitable for administration to a subject.

In some embodiments, the buffered solution further comprises an agent for controlling the osmolality of the solution, such that the osmolality is maintained at a desired value, for example, at the physiological value of human plasma. Solutes that may be added to the buffered solution to control osmolality include, but are not limited to, proteins, peptides, amino acids, non-metabolic polymers, vitamins, ions, sugars, metabolites, organic acids, lipids, or salts. In some embodiments, the agent for controlling the osmolality of the solution is a salt. In some embodiments, the agent for controlling the osmolality of the solution is sodium chloride or potassium chloride.

The pharmaceutical composition of the present disclosure may be administered at a dose sufficient to inhibit the expression of HBV genes. Typically, a suitable dose of the double-stranded RNAi agent of the present disclosure ranges from about 0.001 to 200.0 mg per kilogram of body weight per day, and usually ranges from about 0.1 to 50 mg per kilogram of body weight per day. For example, the double-stranded RNAi agent (e.g., dsRNA) may be administered at a single dose of about 0.01, 0.05, 0.1, 0.2, 0.3, 0.4, 0.5, 0.6, 0.7, 0.8, 0.9, 1, 1.1, 1.2, 1.3, 1.4, 1.5, 1.6, 1.7, 1.8, 1.9, 2, 2.1, 2.2, 2.3, 2.4, 2.5, 2.6, 2.7, 2.8, 2.9, 3, 3.1, 3.2, 3.3, 3.4, 3.5, 3.6, 3.7, 3.8, 3.9, 4, 4.1, 4.2, 4.3, 4.4, 4.5, 4.6, 4.7, 4.8, 4.9, 5, 5.1, 5.2, 5.3, 5.4, 5.5, 5.6, 5.7, 5.8, 5.9, 6, 6.1, 6.2, 6.3, 6.4, 6.5, 6.6, 6.7, 6.8, 6.9, 7, 7.1, 7.2, 7.3, 7.4, 7.5, 7.6, 7.7, 7.8, 7.9, 8, 8.1, 8.2, 8.3, 8.4, 8.5, 8.6, 8.7, 8.8, 8.9, 9, 9.1, 9.2, 9.3, 9.4, 9.5, 9.6, 9.7, 9.8, 9.9, 10, 10.5, 11, 11.5, 12, 12.5, 13, 13.5, 14, 14.5, 15, 15.5, 16, 16.5, 17, 17.5, 18, 18.5, 19, 19.5, 20, 20.5, 21, 21.5, 22, 22.5, 23, 23.5, 24, 24.5, 25, 25.5, 26, 26.5, 27, 27.5, 28, 28.5, 29, 29.5, 30, 31, 32, 33, 34, 34, 35, 36, 37, 38, 39, 40, 41, 42, 43, 44, 45, 46, 47, 48, 49, or about 50 mg/kg.

The pharmaceutical composition may be administered once daily, or the double-stranded RNAi agent may be administered in two, three, or more sub-doses at appropriate intervals throughout the day. Alternatively, it may be administered via continuous infusion or delivery using a controlled-release formulation. In such cases, the amount of double-stranded RNAi agent contained in each sub-dose must be proportionally reduced to achieve the total daily dose. Dose units may also be formulated for delivery over several days, for example, using conventional sustained-release formulations that provide prolonged release of the double-stranded RNAi agent over a period of days. Sustained-release formulations are well-known in the art and are particularly useful for delivering agents to specific sites, and thus they can be used with the agents of the present disclosure. In this embodiment, the dose unit comprises a corresponding multiple of the daily dose.

In other embodiments, a single dose of the pharmaceutical composition may last for an extended period, such that subsequent doses are administered at intervals of no more than 3, 4, or 5 days, or at intervals of no more than 1, 2, 3, or 4 weeks. In some embodiments of the present disclosure, a single dose of the pharmaceutical composition is administered once weekly. In other embodiments of the present disclosure, a single dose of the pharmaceutical composition is administered once monthly.

Those skilled in the art will understand that certain factors may influence the dose and timing required to effectively treat a subject, and these factors include, but are not limited to, the severity of the disease or disorder, prior treatments, the general health and/or age of the subject, and the presence of other diseases. Furthermore, treating a subject with a therapeutically effective dose of the composition may involve a single treatment or a series of treatments. As described elsewhere herein, the effective dose and in vivo half-life of the various double-stranded RNAi agents encompassed by the present disclosure can be estimated using conventional methods or in vivo testing based on suitable animal models.

Depending on whether local or systemic treatment is desired and depending on the area to be treated, the pharmaceutical composition of the present disclosure may be administered in various ways. Administration may be topical (e.g., via a skin patch); pulmonary, for example, via inhalation or insufflation of a powder or aerosol, including through a nebulizer; intratracheal; intranasal; epidermal and transdermal; oral; or parenteral. Parenteral administration includes intravenous, intra-arterial, subcutaneous, intraperitoneal, or intramuscular injection or infusion; subdermal, for example, via an implantable device; or intracranial, such as intraparenchymal, intrathecal, or intraventricular administration.

The double-stranded RNAi agent used in the composition and method of the present disclosure may be formulated for delivery within membranous molecular assemblies, such as liposomes or micelles. As used herein, the term "liposome" refers to a vesicle composed of amphipathic lipids arranged in at least one bilayer (e.g., a single bilayer or multiple bilayers). Liposomes include unilamellar or multilamellar vesicles with a membrane formed from lipophilic materials and an aqueous interior. The aqueous portion comprises the composition comprising the double-stranded RNAi agent. The lipophilic material separates the aqueous interior from an aqueous exterior, which typically does not comprise the composition comprising the double-stranded RNAi agent (although in some instances, it may). Liposomes are useful for transferring and delivering active ingredients to sites of action. Because the liposome membrane is structurally similar to biological membranes, when liposomes are administered to a tissue, the liposome bilayer fuses with the cell membrane. As the liposome fuses with the cell, the internal aqueous contents, comprising the double-stranded RNAi agent, are delivered into the cell, where the double-stranded RNAi agent can specifically bind to a target RNA and mediate RNA interference (RNAi). In some cases, these liposomes are also specifically targeted, for example, to direct the double-stranded RNAi agent to a specific cell type.

Liposomes comprising the double-stranded RNAi agent may be prepared using various methods. In one example, lipid components of the liposome are dissolved in a detergent, allowing the formation of micelles with the lipid components. For example, the lipid components may include amphipathic cationic lipids or lipid conjugates. The detergent may have a high critical micelle concentration (CMC) and can be non-ionic. Exemplary detergents include cholate, CHAPS, octyl glucoside, deoxycholate, and lauroyl sarcosinate. Subsequently, the double-stranded RNAi agent is added to the micelles formed with the lipid components. The cationic groups on the lipids interact with the double-stranded RNAi agent and condense around it to form a liposome. After condensation, the detergent is removed, for example, through dialysis, to obtain a liposomal formulation of the double-stranded RNAi agent.

Double-stranded RNAi agents, such as the dsRNA of the present disclosure, may be fully encapsulated in lipid formulations, such as lipid nanoparticles (LNP) or other nucleic acid-lipid particles.

As used herein, the term "lipid nanoparticle (LNP)" refers to a stable nucleic acid-lipid particle. A LNP contains a cationic lipid, a non-cationic lipid, and a lipid that prevents particle aggregation (e.g., a PEG-lipid conjugate). LNPs are highly useful for synthetic applications because they exhibit prolonged circulation lifetimes after intravenous (i.v.) injection and accumulate at distal sites (e.g., sites physically separated from the administration site).

In one embodiment, the lipid-to-drug ratio (mass/mass ratio) (e.g., the lipid-to-dsRNAratio) will range from about 1:1 to about 50:1, from about 1:1 to about 25:1, from about 3:1 to about 15:1, from about 4:1 to about 10:1, from about 5:1 to about 9:1, or from about 6:1 to about 9:1.

In some embodiments, the double-stranded RNAi agent or the conjugate is administered in a non-buffered solution.

In some embodiments, the non-buffered solution is saline or water.

In some embodiments, the double-stranded RNAi agent or the conjugate is administered with a buffered solution.

In some embodiments, the buffered solution includes acetate, citrate, prolamine, carbonate, or phosphate, or any combination thereof.

In some embodiments, the buffered solution is phosphate-buffered solution.

In some embodiments, the double-stranded RNAi agent or the conjugate is formulated into a lipid formulation for delivery within membranous molecular assemblies.

In some embodiments, the lipid formulation is a nucleic acid-lipid particle.

In some embodiments, the lipid formulation is a lipid nanoparticle.

In some embodiments, the mass-to-mass ratio of lipid to the double-stranded RNAi agent or the conjugate is 1:1 to 50:1, 1:1 to 25:1, 3:1 to 15:1, 4:1 to 10:1, 5:1 to 9:1, or 6:1 to 9:1.

In some embodiments, the lipid nanoparticle comprises a cationic lipid, a neutral lipid, a structural lipid, and a polymer-conjugated lipid.

In some embodiments, the cationic lipid is a compound of formula (I), or a N-oxide, solvate, pharmaceutically acceptable salt, or stereoisomer thereof, (I)

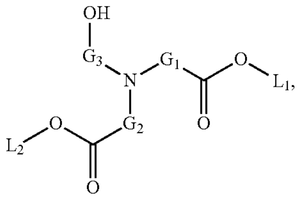

wherein $G_1$ is a $C_{1-6}$ alkylene group; $G_2$ is a $C_{2-8}$ alkylene group; $G_3$ is a $C_{1-3}$ alkylene group; $L_1$ is a $C_{6-15}$ linear alkyl group; $L_2$ is a $C_{12-25}$ branched alkyl group.

In some embodiments, the cationic lipid is YK-009 of formula (I-I) (see CN114044741B):

(I-I)

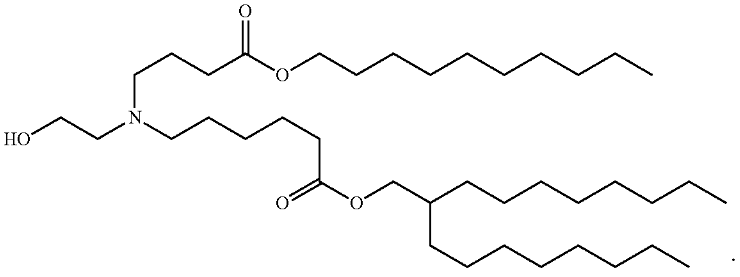

YK-009

In some embodiments, the cationic lipid is a compound of formula (II), or a N-oxide, solvate, pharmaceutically acceptable salt, or stereoisomer thereof, (II)

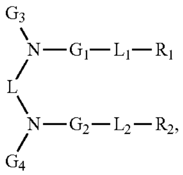

wherein $G_1$ is a $C_{2-8}$ alkylene group; $G_2$ is a $C_{2-8}$ alkylene group; $L_1$ is —C(O)O— or —OC(O)—; $L_2$ is —C(O)O— or —OC(O)—; $R_1$ is a $C_{6-25}$ linear or branched alkyl group; $R_2$ is a $C_{6-25}$ linear or branched alkyl group; $G_3$ is $HO(CH_2)_2$— or $HO(CH_2)_3$—; $G_4$ is $HO(CH_2)_2$— or $HO(CH_2)_3$—; L is —$(CH_2)_2$—, —$(CH_2)_3$—, or —$(CH_2)_4$—.

In some embodiments, the cationic lipid is YK-401 of formula (II-I) or YK-402 of formula (II-II) (see CN115784921B):

In some embodiments, the cationic lipid is a compound of formula (III), or a N-oxide, solvate, pharmaceutically acceptable salt, or stereoisomer thereof, (III)

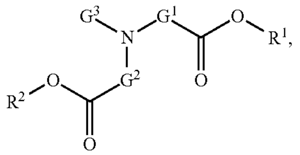

wherein $G_1$ is a $C_{1-6}$ alkylene group; $G_2$ is a $C_{2-8}$ alkylene group; $R_1$ is a $C_{6-20}$ linear or branched alkyl group; $R_2$ is a $C_{12-25}$ branched alkyl group; $G_3$ is $HO(CH_2)_2N(CH_3)(CH_2)_2$—, $HO(CH_2)_2N(CH_2CH_3)(CH_2)_2$—, $(HO(CH_2)_2)_2N(CH_2)_2$—, $CH_3O(CH_2)_2N(CH_3)(CH_2)_2$—, $(CH_3)_2N(CH_2)_3SC(O)O(CH_2)_2$—, $(CH_3)_2N(CH_2)_3SC(O)$—, $CH_3NH(CH_2)_2N(CH_3)(CH_2)_2$—, or $CH_3CH_2NH(CH_2)_2$—.

In some embodiments, the cationic lipid is YK-201 of formula (III-I) or YK-202 of formula (III-II) (see CN115677518B):

(II-I)

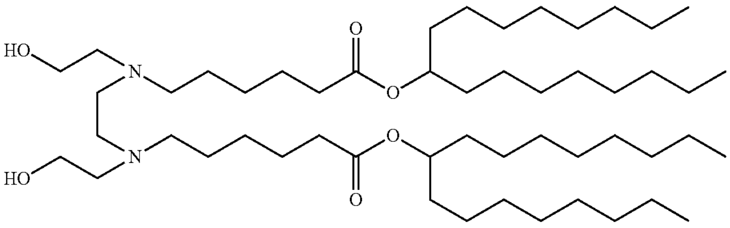

,

YK-401

(II-II)

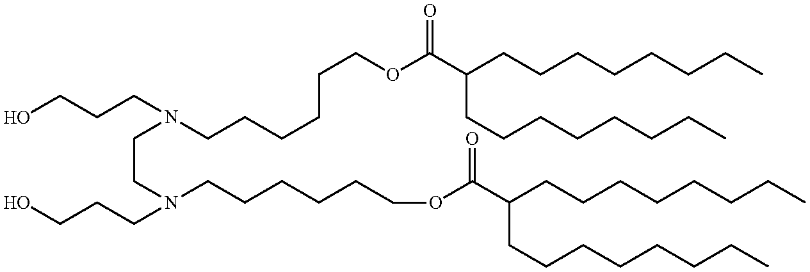

.

YK-402

(III-I)

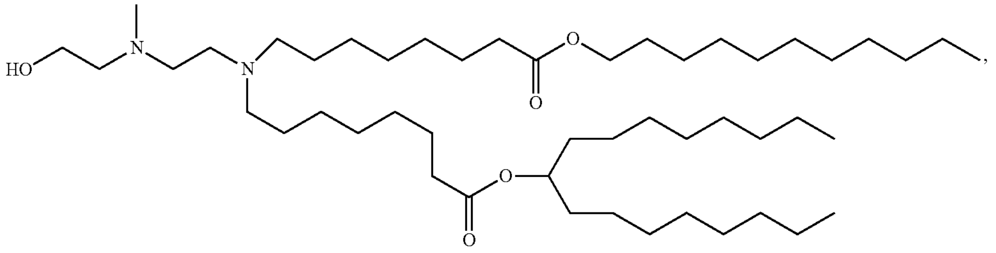

YK-201

(III-II)

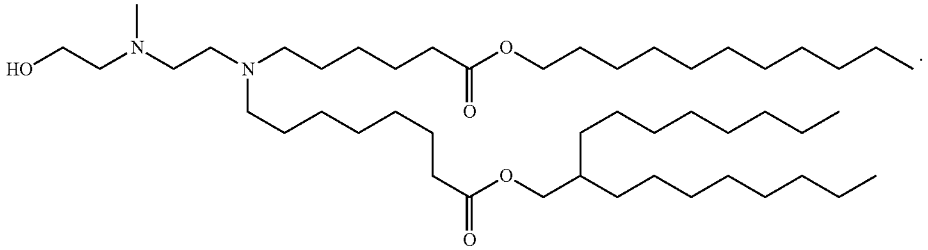

YK-202

In some embodiments, the cationic lipid is a compound of formula (IV), or a N-oxide, solvate, pharmaceutically acceptable salt, or stereoisomer thereof, (IV)

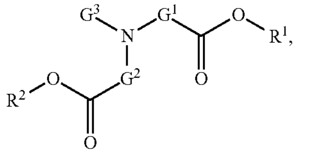

wherein $G_1$ is a $C_{1-8}$ alkylene group; $G_2$ is a $C_{2-8}$ alkylene group; $R_1$ is a $C_{6-25}$ linear or branched alkyl group; $R_2$ is a $C_{12-25}$ linear or branched alkyl group; $G_3$ is $HO(CH_2)_2N(R_3)CH_2CH(OH)CH_2$—, where $R_3$ is —$CH_3$, —$CH_2CH_3$, or —$CH_2CH_2OH$.

In some embodiments, the cationic lipid is YK-305 of formula (IV-I) or YK-310 of formula (IV-II) (see CN115745820B):

(IV-I)

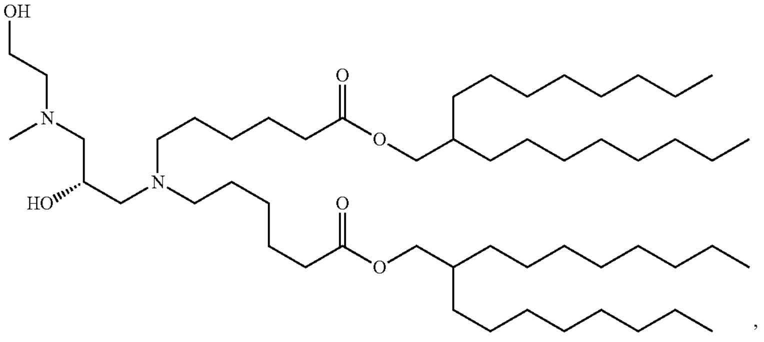

YK-305

-continued (IV-II)

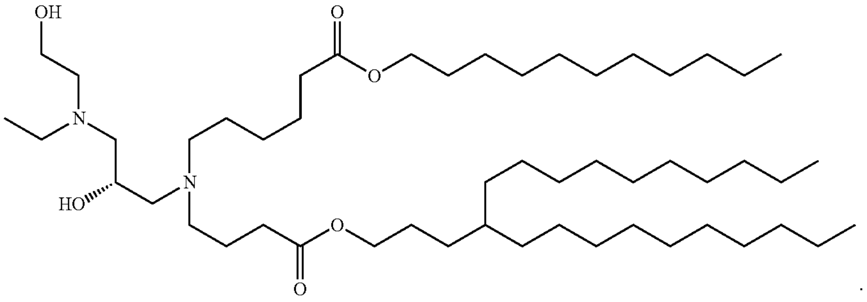

YK-310

In some embodiments, the cationic lipid is a compound of formula (V), or a N-oxide, solvate, pharmaceutically acceptable salt, or stereoisomer thereof, (V)

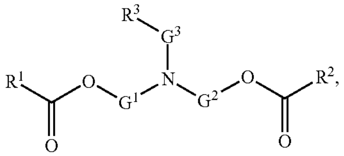

$G^1$ and $G^2$ are each independently an unsubstituted $C_6$-$C_{10}$ alkylene group; $G^3$ is an unsubstituted $C_1$-$C_{12}$ alkylene group; $R^1$ and $R^2$ are each independently a $C_6$-$C_{24}$ alkyl group or a $C_6$-$C_{24}$ alkenyl group; $R^3$ is $OR^5$, N, —C(═O)$OR^4$, —OC(═O)$R^4$, or —$NR^5$C(═O)$R^4$; $R^4$ is a $C_1$-$C_{12}$ hydrocarbon group; and $R^5$ is H or a $C_1$-$C_6$ hydrocarbon group.

In some embodiments, the cationic lipid is ALC0315 of formula (V-I) (see CN108368028B):

(V-I)

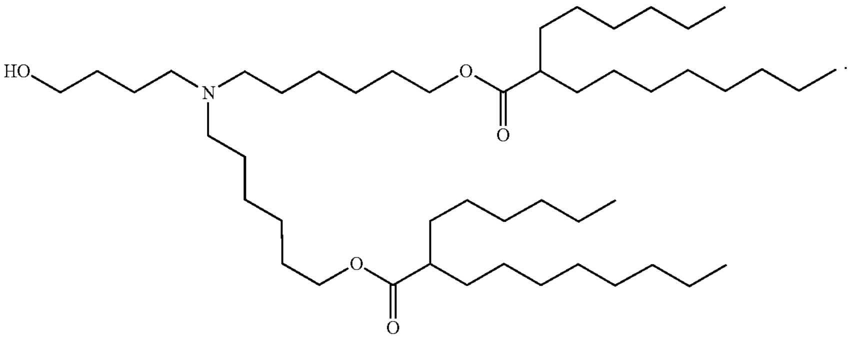

In some embodiments, the cationic lipid is a compound of formula (VI), or a N-oxide, solvate, pharmaceutically acceptable salt, or stereoisomer thereof, (VI)

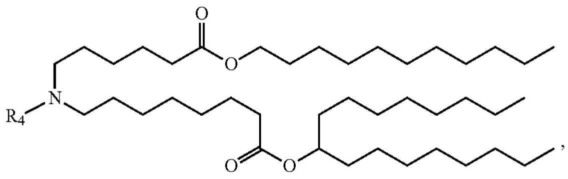

$R_4$ is selected from $-(CH_2)_nQ$ and $-(CH_2)_nCHQR$; Q is selected from the group consisting of $-OR$, $-OH$, $-O(CH_2)_nN(R)_2$, $-OC(O)R$, $-CX_3$, $-CN$, $-N(R)C(O)R$, $-N(H)C(O)R$, $-N(R)S(O)_2R$, $-N(H)S(O)_2R$, $-N(R)C(O)N(R)_2$, $-N(H)C(O)N(R)_2$, $-N(H)C(O)N(H)(R)$, $-N(R)C(S)N(R)_2$, $-N(H)C(S)N(R)_2$, $-N(H)C(S)N(H)(R)$, $-N(R)S(O)_2R_8$, and a heterocyclic group; n is 1, 2, or 3.

In some embodiments, the cationic lipid is SM102 of formula (VI-I) (see CN110520409A):

(VI-I)

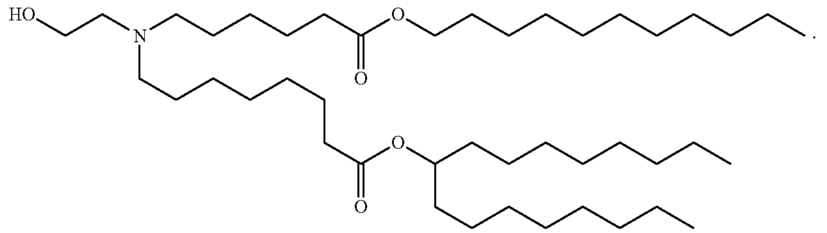

In some embodiments, the cationic lipid is the compound DLIN-MC3-DIVA of formula (VII) (see CN102625696B), or a N-oxide, solvate, pharmaceutically acceptable salt, or stereoisomer thereof, (VII)

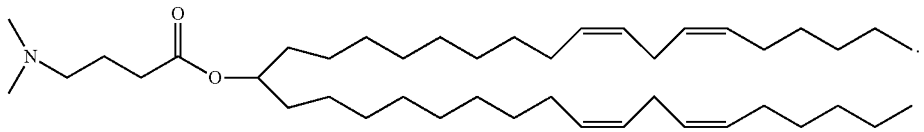

In some embodiments, the cationic lipid comprises one or more selected from YK-009, YK-401, YK-305, ALC-0315, SM-102, and DLin-MC3-DMA.

In some embodiments, the cationic lipid and the neutral lipid are present in a molar ratio of 1:1 to 10:1.

In some embodiments, the cationic lipid and the structural lipid are present in a molar ratio of 1:1 to 5:1.

In some embodiments, the cationic lipid, the neutral lipid, the structural lipid, and the polymer-conjugated lipid are present in a molar ratio of (25-65):(5-25):(25-70):(0.5-5).

In some embodiments, the cationic lipid, the neutral lipid, the structural lipid, and the polymer-conjugated lipid are present in a molar ratio of (25-65):(5-25):(25-45):(0.5-5).

In some embodiments, the cationic lipid, the neutral lipid, the structural lipid, and the polymer-conjugated lipid are present in a molar ratio of 50:10:38.5:1.5 or 49:10:39.5:1.5.

In some embodiments, the neutral lipid comprises one or more selected from phosphatidylcholine, phosphatidylethanolamine, sphingomyelin, ceramide, sterols, and derivatives thereof.

In some embodiments, the neutral lipid is selected from one or more of the following: 1,2-dilinoleoyl-sn-glycero-3-phosphocholine (DLPC), 1,2-dimyristoyl-sn-glycero-3-phosphocholine (DMPC), 1,2-dioleoyl-sn-glycero-3-phosphocholine (DOPC), 1,2-dipalmitoyl-sn-glycero-3-phosphocholine (DPPC), 1,2-distearoyl-sn-glycero-3-phosphocholine (DSPC), 1,2-diundecanoyl-sn-glycero-3-phosphocholine (DUPC), 1-palmitoyl-2-oleoyl-sn-glycero-3-phosphocholine (POPC), 1,2-di-O-octadecenyl-sn-glycero-3-phosphocholine (18:0 Diether PC), 1-oleoyl-2-cholesterylhemisuccinoyl-sn-glycero-3-phosphocholine (OChemsPC), 1-hexadecyl-sn-glycero-3-phosphocholine (C16 Lyso PC), 1,2-dilinolenoyl-sn-glycero-3-phosphocholine, 1,2-diarachidonoyl-sn-glycero-3-phosphocholine, 1,2-didocosahexaenoyl-sn-glycero-3-phosphocholine, 1,2-dioleoyl-sn-glycero-3-phosphoethanolamine (DOPE), 1,2-diphytanoyl-sn-glycero-3-phosphoethanolamine (ME 16.0PE), 1,2-distearoyl-sn-glycero-3-phosphoethanolamine, 1,2-dilinoleoyl-sn-glycero-3-phosphoethanolamine, 1,2-dilinolenoyl-sn-glycero-3-phosphoethanolamine, 1,2-diarachidonoyl-sn-glycero-3-phosphoethanolamine, 1,2-didocosahexaenoyl-sn-glycero-3-phosphoethanolamine, 1,2-dioleoyl-sn-glycero-3-phospho-rac-(1-glycerol) sodium salt (DOPG), dipalmitoylphosphatidylglycerol (DPPG), palmitoyloleoylphosphatidylethanolamine (POPE), distearoylphosphatidylethanolamine (DSPE), dipalmitoylphosphatidylethanolamine (DPPE), dimyristoylphosphatidylethanolamine (DMPE), 1-stearoyl-2-oleoyl-sn-glycero-3-phosphoethanolamine (SOPE), 1-stearoyl-2-oleoyl-phosphatidylcholine (SOPC), sphingomyelin, phosphatidylcholine, phosphatidylethanolamine, phosphatidylserine, phosphatidylinositol, phosphatidic acid, palmitoyloleoylphosphatidylcholine, lysophosphatidylcholine, lysophosphatidylethanolamine (LPE), and mixtures thereof.

In some embodiments, the neutral lipid is 1,2-dioleoyl-sn-glycero-3-phosphoethanolamine (DOPE) and/or 1,2-distearoyl-sn-glycero-3-phosphocholine (DSPC).

In some embodiments, the structural lipid is selected from one or more of the following: cholesterol, non-sterols, sitosterol, ergosterol, campesterol, stigmasterol, brassicasterol, tomatidine, ursolic acid, α-tocopherol, and corticosteroids.

In some embodiments, the structural lipid is cholesterol.

In some embodiments, the polymer-conjugated lipid is selected from one or more of the following: PEG-modified phosphatidylethanolamine, PEG-modified phosphatidic acid, PEG-modified ceramide, PEG-modified dialkylamine, PEG-modified diacylglycerol, and PEG-modified dialkylglycerol.

In some embodiments, the polymer-conjugated lipid is selected from one or more of the following: distearoylphosphatidylethanolamine-polyethylene glycol 2000 (DSPE-PEG2000), dimyristoylglycerol-3-methoxypolyethylene glycol 2000 (DMG-PEG2000), and methoxypolyethylene glycol bis(tetradecyl)acetamide (ALC-0159).

The pharmaceutical compositions of the present disclosure include, but are not limited to, solutions, emulsions, and lipid-containing formulations. These compositions can be derived from a variety of components, including but not limited to pre-formed liquids, self-emulsifying solids, and self-emulsifying semi-solids. Particularly preferred are formulations that target the liver when treating liver diseases (e.g., liver cancer).

The pharmaceutical compositions of the present disclosure (which may conveniently be provided in unit dosage forms) can be prepared according to conventional techniques well-known in the pharmaceutical industry. Such techniques include a step of combining the active ingredient (s) with the pharmaceutical carrier(s) or excipient(s). In general, these pharmaceutical compositions are prepared by uniformly and intimately combining the active ingredient(s) with a liquid carrier, a finely divided solid carrier, or both, and, if necessary, subsequently shaping the product.

The pharmaceutical compositions of the present disclosure may be formulated into any of a number of possible dosage forms, including but not limited to tablets, capsules, gel capsules, liquid syrups, soft capsules, suppositories, and enemas. The pharmaceutical compositions of the present disclosure may also be formulated as suspensions in aqueous, non-aqueous, or mixed media. An aqueous suspension may further comprise a substance that increases the viscosity of the suspension, such as sodium carboxymethyl cellulose, sorbitol, and/or dextran. The suspension may further comprise a stabilizer.

Certain pharmaceutical compositions of the present disclosure further incorporate a carrier compound into the formulation. As used herein, the term "carrier compound" or "carrier" may refer to a nucleic acid or analog thereof that is inert (i.e., lacks biological activity on its own) but is recognized as a nucleic acid in biological processes, such as by degrading biologically active nucleic acids or promoting their removal from circulation, thereby reducing the bioavailability of the biologically active nucleic acid. Co-administration of a nucleic acid and a carrier compound (typically with the latter in excess) can result in a significant reduction in the amount of nucleic acid recovered in the liver, kidneys, or other extravascular reservoirs, presumably due to competition for shared receptors between the carrier compound and the nucleic acid. For example, the recovery of partially phosphorothioated dsRNA in liver tissue can be reduced when co-administered with polyinosinic acid, dextran sulfate, polycytidylic acid, or 4-acetamido-4'-isothiocyanatostilbene-2,2'-disulfonic acid.

In contrast to carrier compounds, the term "pharmaceutical carrier" or "excipient" refers to a pharmaceutically acceptable solvent, suspending agent, or any other pharmaceutically inert vehicle used to deliver one or more nucleic acids to an animal. The excipient may be liquid or solid and is selected based on the intended route of administration to provide the desired volume, consistency, and other properties when combined with the nucleic acid and other components of the specific pharmaceutical composition. Typical pharmaceutical carriers include, but are not limited to binders (e.g., pregelatinized corn starch, polyvinylpyrrolidone, or hydroxypropyl methylcellulose); fillers (e.g., lactose and other sugars, microcrystalline cellulose, pectin, gelatin, calcium sulfate, ethyl cellulose, polyacrylates, or calcium hydrogen phosphate); lubricants (e.g., magnesium stearate, talc, silica, colloidal silica, stearic acid, metal stearates, hydrogenated vegetable oils, corn starch, polyethylene glycol, sodium benzoate, or sodium acetate); disintegrants (e.g., starch, sodium starch glycolate); and wetting agents (e.g., sodium lauryl sulfate).

Pharmaceutically acceptable organic or inorganic excipients suitable for non-parenteral administration and do not exhibit toxic interactions with nucleic acids may also be used to formulate the pharmaceutical compositions of the present disclosure. Suitable pharmaceutically acceptable carriers include, but are not limited to water, salt solutions, alcohols, polyethylene glycol, gelatin, lactose, amylose, magnesium stearate, talc, silica, viscous paraffin, hydroxymethyl cellulose, polyvinylpyrrolidone, and the like.

Formulations for topical administration of nucleic acids may include sterile/non-sterile aqueous/non-aqueous solutions in common solvents such as alcohol, or nucleic acid solutions in liquid or solid oil bases. These solutions may also include buffers, diluents, and other suitable additives. Pharmaceutically acceptable organic or inorganic excipients suitable for non-parenteral administration and do not exhibit toxic interactions with nucleic acids may be used.

Suitable pharmaceutically acceptable excipients include, but are not limited to water, salt solutions, alcohols, polyethylene glycol, gelatin, lactose, amylose, magnesium stearate, talc, silica, viscous paraffin, hydroxymethyl cellulose, polyvinylpyrrolidone, and the like.

The dosage forms, carrier compounds, pharmaceutical carriers, excipients, and the like described above are detailed in U.S. Pat. No. 10,125,369B2, which is incorporated herein by reference.

In another aspect, the present disclosure provides a kit, wherein the kit comprises a kit A, and the kit A comprises one or more of the aforementioned double-stranded RNAi agent, the conjugate, or the pharmaceutical composition.

In some embodiments, the kit further comprises a kit B, and the kit B comprises one or both of the following:

(1) an additional drug that reduces HBV gene expression or a composition comprising the drug that reduces HBV gene expression;

(2) one or more agents selected from the group consisting of hormone preparations, targeted small molecule agents, proteasome inhibitors, imaging agents, diagnostic agents, chemotherapeutic agents, oncolytic drugs, cytotoxic agents, cytokines, activators of co-stimulatory molecules, inhibitors of inhibitory molecules, and vaccines.

As used herein, the phrase "an additional drug that reduces HBV gene expression or a composition comprising the drug that reduces HBV gene expression" refers to drugs that do not contain the double-stranded RNAi agent, conjugate, or pharmaceutical composition provided in the present disclosure.

In another aspect, the present disclosure provides a use of the double-stranded RNAi agent, the conjugate, or the pharmaceutical composition in the preparation of a medicament for preventing and/or treating a disease associated with HBV gene expression.

In some embodiments, the disease associated with HBV gene expression is selected from the following disease types: chronic hepatitis B, liver fibrosis, liver cirrhosis, liver cancer, acute hepatitis B, and HBV/hepatitis D virus co-infection-associated diseases.

In another aspect, the present disclosure provides a method for reducing HBV gene expression or inhibiting HBV replication for non-preventive and/or non-therapeutic purposes, wherein the method comprises administering to a sample one or more of the aforementioned double-stranded RNAi agent, conjugate, pharmaceutical composition, or kit.

As used herein, the term "non-preventive and/or non-therapeutic purpose" refers to cases of reducing HBV gene expression or inhibiting HBV replication, for example, for research purposes in a laboratory setting.

Nucleotide abbreviations used herein are as follows:

A=Adenosine-3'-phosphate
Am=2'-Methoxyadenosine-3'-phosphate
Ams=2'-Methoxyadenosine-3'-phosphorothioate
Af=2'-Fluoroadenosine-3'-phosphate
Afs=2'-Fluoroadenosine-3'-phosphorothioate
G=Guanosine-3'-phosphate
Gm=2'-Methoxyguanosine-3'-phosphate
Gms=2'-Methoxyguanosine-3'-phosphorothioate
Gf=2'-Fluoroguanosine-3'-phosphate
Gfs=2'-Fluoroguanosine-3'-phosphorothioate
C=Cytidine-3'-phosphate
Cm=2'-Methoxycytidine-3'-phosphate
Cms=2'-Methoxycytidine-3'-phosphorothioate
Cf=2'-Fluorocytidine-3'-phosphate
Cfs=2'-Fluorocytidine-3'-phosphorothioate
U=Uridine-3'-phosphate
Um=2'-Methoxyuridine-3'-phosphate
Ums=2'-Methoxyuridine-3'-phosphorothioate
Uf=2'-Fluorouridine-3'-phosphate
Ufs=2'-Fluorouridine-3'-phosphorothioate
AmsEVP=5'-(E)-vinylphosphonate-2'-O-methyl-adenosine-3'-phosphorothioate
UmsEVP=5'-(E)-vinylphosphonate-2'-O-methyl-uridine-3'-phosphorothioate
A(gna)=Adenosine-glycol nucleic acid
C(gna)=Cytidine-glycol nucleic acid
G(gna)=Guanosine-glycol nucleic acid
T(gna)=Thymidine-glycol nucleic acid
U(gna)=Uridine-glycol nucleic acid
dA=Deoxyadenosine-3'-phosphate
dG=Deoxyguanosine-3'-phosphate
dC=Deoxycytidine-3'-phosphate
dT=Deoxythymidine-3'-phosphate The following examples are provided to illustrate the present disclosure but are not intended to limit its scope. Unless otherwise specified, the technical methods used in the examples are conventional methods well-known to those skilled in the art, and all raw materials are commercially available products.

Example 1: Synthesis of Small Interfering Oligonucleotides Modified Using the DV29P Template A total of 36 siRNA unmodified sequences were designed, with Alnylam's VIR-2218 used as the positive control (referred to as APC-VIR in this example) and ANC-DV29P used as the negative control. The unmodified sequences were modified using the DV29P template. In the sense strand, positions 7, 9, 11, and 17 were modified with 2'-F, while the remaining positions were modified with 2'-OMe. In the antisense strand, positions 2, 4, 5, 6, 14, and 16 were modified with 2'-F, while the remaining positions were modified with 2'-OMe. Additionally, the 5' end of the sense strand has two phosphorothioate modifications. The antisense strand has two phosphorothioate modifications at both the 5' and 3' ends, as well as one EVP modification at the 5' end. The sequences of the DV29P template-modified siRNAs are listed in Table 1.

1. Synthesis of the DV29P Template-Modified Sequence A194-DV29P

In table 1, the unmodified sequence of the small interfering ribonucleic acid (siRNA) with the sequence code A194-DV29P is as follows:

```
Sense strand:
                                        (SEQ ID NO: 15)
5'-UCGUGUUACAGGCGGGGUUUU-3'

Antisense strand:
                                        (SEQ ID NO: 47)
5'-AAAACCCCGCCUGUAACACGAGA-3'
```

In the sense strand, positions 7, 9, 11, and 17 were modified with 2'-F, while the remaining positions were modified with 2'-OMe. In the antisense strand, positions 2, 4, 5, 6, 14, and 16 were modified with 2'-F, while the remaining positions were modified with 2'-OMe. Additionally, the 5' end of the sense strand has two phosphorothioate modifications. The antisense strand has two phosphorothioate modifications at both the 5' and 3' ends, as well as one EVP modification at the 5' end.

Instruments and reagents: The DNA/RNA automatic synthesizer used is the Tsingke 192P model. The solid-phase support is a universal support composed of cross-linked polystyrene beads, specifically the Primer Support 5G Unylinker 350 (manufactured by Cytiva).

Preparation Method:

The following nucleotide monomer solutions were prepared using acetonitrile as the solvent, with a monomer concentration of 0.15 M: DMT-A-OMe phosphoramidite monomer (formula 1), DMT-C-OMe phosphoramidite monomer (formula 2), DMT-G-OMe phosphoramidite monomer (formula 3), DMT-U-OMe phosphoramidite monomer (formula 4), DMT-A-F phosphoramidite monomer (formula 5), DMT-C-F phosphoramidite monomer (formula 6), DMT-G-F phosphoramidite monomer (formula 7), DMT-U-F phosphoramidite monomer (formula 8), (E)-vinylphosphonate-A-OMe phosphoramidite monomer (formula 9), (E)-vinylphosphonate-U-OMe phosphoramidite monomer (formula 10).

formula 1

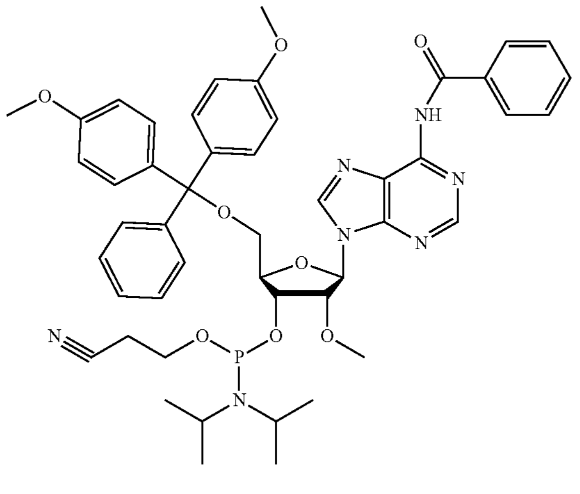

-continued
formula 2
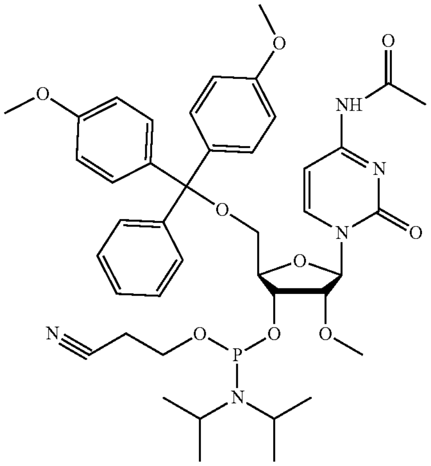
formula 3
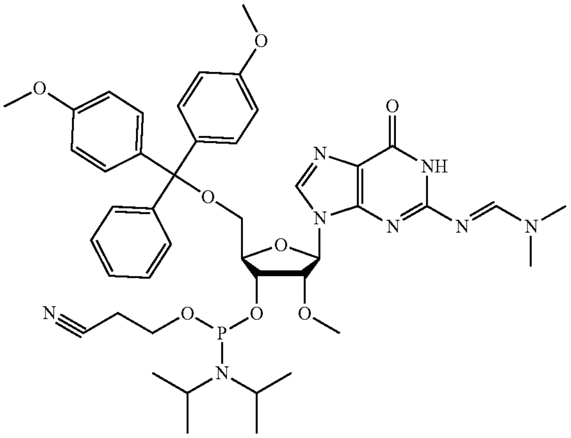
formula 4
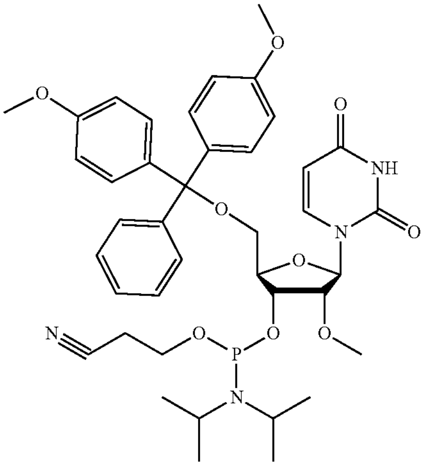
-continued
formula 5
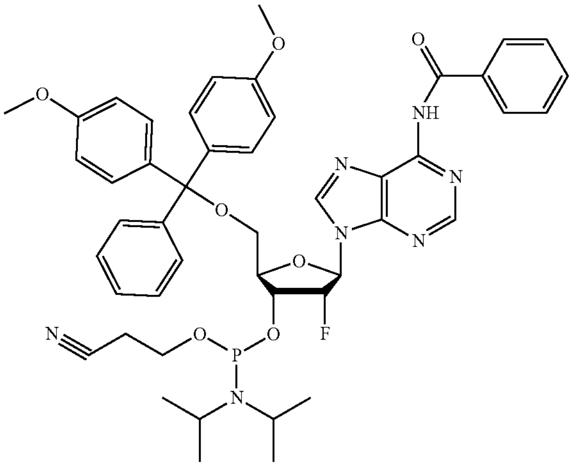
formula 6
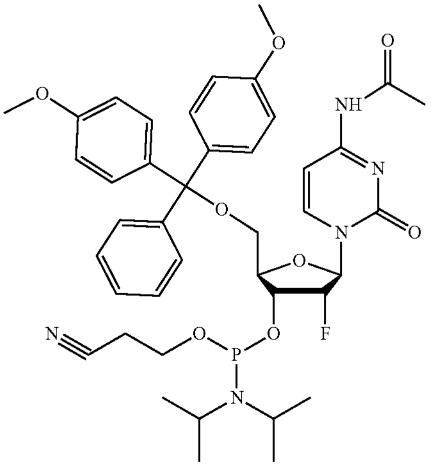
formula 7
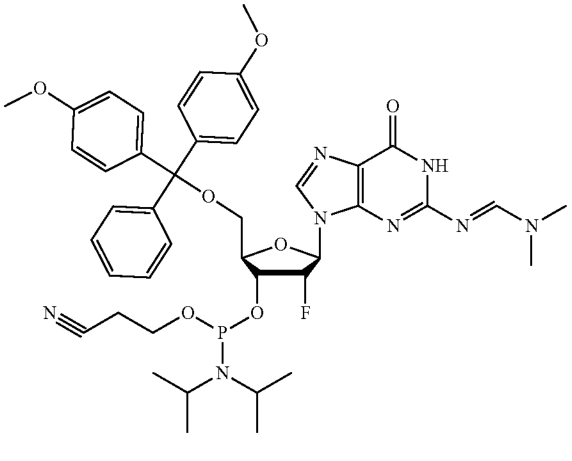

-continued
formula 8
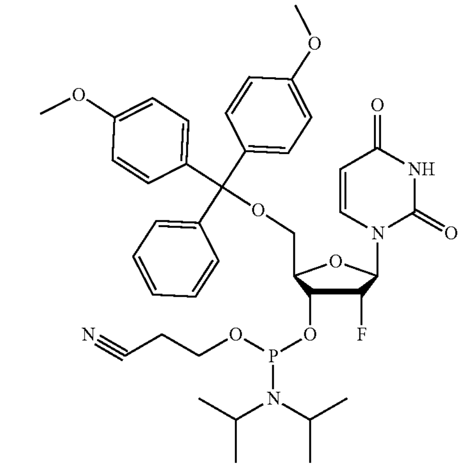
formula 9
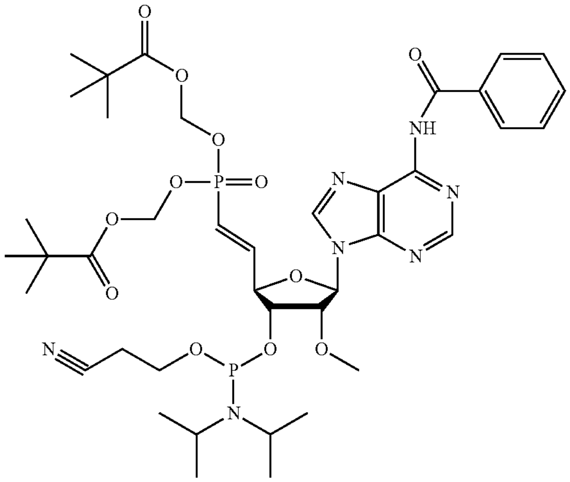
formula 10
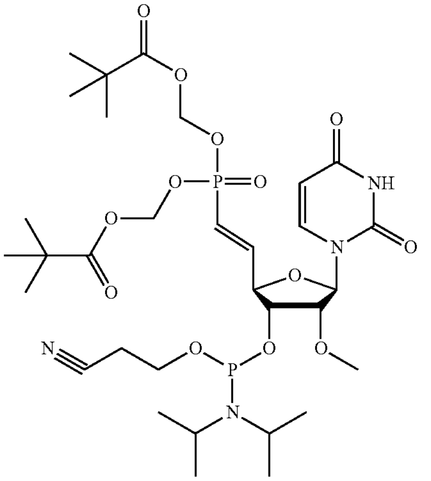
The 7th base from the 5' end of the antisense strand in the positive control sequence APC-VIR is modified with glycol nucleic acid (GNA), and the GNA monomer structures are as follows:
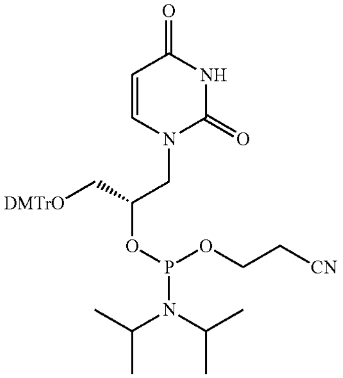
(S)-GNA-U
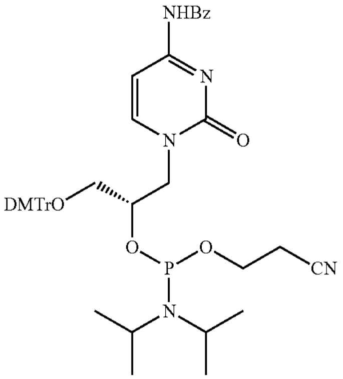
(S)-GNA-C
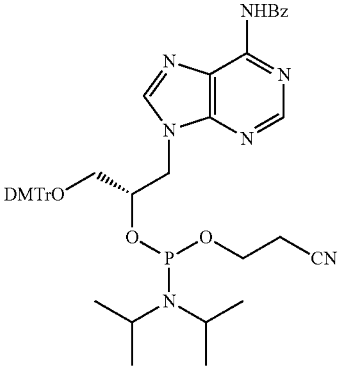
(S)-GNA-A
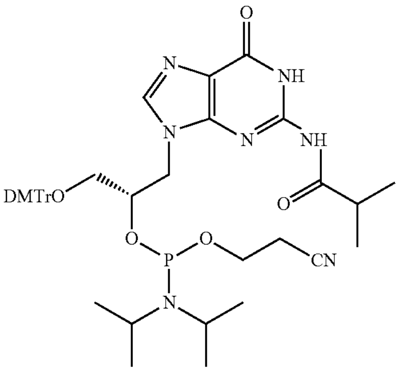
(S)-GNA-G Preparation steps are as follows:

(1) Deprotection:

A 3% dichloroacetic acid solution in toluene was used as the deprotection reagent to remove the DMT protecting group. Subsequently the product was washed with acetonitrile.

(2) Coupling:

A 0.25 M solution of 5-ethylthio-1H-tetrazole in acetonitrile was used as the activator for coupling each nucleotide monomer solution in acetonitrile. Subsequently the product was rinsed with acetonitrile.

(3) Oxidation/Sulfurization:

Oxidation: A 0.05 M iodine solution in pyridine/water (90/10, v/v) was used as the oxidizing agent for oxidation. Subsequently the product was rinsed with acetonitrile.

Sulfurization: A 3% solution of hydrogen xanthate in pyridine was used as the sulfurizing agent for sulfurization. Subsequently the product was rinsed with acetonitrile.

(4) Hydroxyl Protection:

A 10% acetic anhydride solution in tetrahydrofuran (CAP A) and a mixture of tetrahydrofuran/pyridine/N-methylimidazole (74/10/16, v/v/v) (CAP B) were used as hydroxyl protection reagents for hydroxyl protection. Subsequently the product was rinsed with acetonitrile.

The above steps were repeated in cycles according to the designed sequence to obtain the fully protected product.

(5) A 3% Dichloroacetic Acid Solution in Toluene was Used as the Deprotection Reagent to Remove the DMT Protecting Group from the Last Nucleotide. Subsequently the Product was Washed with Acetonitrile.

(6) Ammonolysis and Purification:

The solid-phase support was transferred to a reactor, and concentrated aqueous ammonia (25-28%) was added. The mixture was maintained at 60° C. for 12 hours for ammonolysis. After cooling to room temperature, the mixture was filtered and was washed with a mixture of purified water and ethanol. The combined filtrate was passed through a chromatography column, concentrated, and lyophilized to obtain the product.

(7) Annealing The purified sense strand and antisense strand were mixed in a 1:1 ratio, heated to 95° C. for 3 minutes, and then slowly cooled to room temperature to form the double-stranded product.

A194-DV29P purity: 90.52%; measured molecular weight: 14,727.09.

2. Synthesis of Other Sequences

The synthesis of other sequences in Table 1 was carried out according to the method described above.

TABLE 1

DV29P template-modified siRNA sequences

| unmodified sequence code | Sequence code | Sense strand sequence 5'-3' | Sequence ID No | Corresponding unmodified sequence ID No | Antisense strand sequence 5'-3' | Sequence ID No | Corresponding basic sequence ID No |
|---|---|---|---|---|---|---|---|
| B207S | B207S-DV29P | Gms-Gms-Gm-Gm-Um-Uf-Um-Uf-Um-Cf-Um-Um-Gm-Um-Um-Gf-Am-Cm-Am-Am | 81 | 1 | UmsEVP-Ufs-Gm-Uf-Cf-Af-Am-Cm-Am-Am-Gm-Am-Am-Af-Am-Af-Cm-Cm-Cm-Cms-Gms-Cm | 179 | 8 |
| A1550 | A1550-DV29P | Cms-Cms-Cm-Gm-Um-Cm-Uf-Gm-Uf-Gm-Cf-Cm-Um-Um-Cm-Um-Cf-Am-Um-Cm-Um | 86 | 2 | AmsEVP-Gfs-Am-Uf-Gf-Af-Gm-Am-Am-Gm-Gm-Cm-Am-Cf-Am-Gf-Am-Cm-Gm-Gm-Gms-Gms-Am | 187 | 9 |
| B1572 | B1572-DV29P | Cms-Cms-Gm-Gm-Am-Cm-Cf-Gm-Uf-Gm-Uf-Gm-Cm-Am-Cm-Um-Uf-Cm-Gm-Cm-Um | 91 | 3 | AmsEVP-Gfs-Cm-Gf-Af-Af-Gm-Um-Gm-Cm-Am-Cm-Am-Cf-Gm-Gf-Um-Cm-Cm-Gm-Gms-Cms-Am | 195 | 10 |
| B1575 | B1575-DV29P | Gms-Ams-Cm-Cm-Gm-Um-Gf-Um-Gf-Cm-Af-Cm-Um-Um-Cm-Gm-Cf-Um-Um-Cm-Am | 96 | 4 | UmsEVP-Gfs-Am-Af-Gf-Cf-Gm-Am-Am-Gm-Um-Gm-Cm-Af-Cm-Af-Cm-Gm-Gm-Um-Cms-Cms-Gm | 201 | 11 |
| A1573 | A1573-DV29P | Cms-Gms-Gm-Am-Cm-Cm-Gf-Um-Gf-Um-Gf-Cm-Am-Cm-Um-Um-Cf-Gm-Cm-Um-Um | 101 | 5 | AmsEVP-Afs-Gm-Cf-Gf-Af-Am-Gm-Um-Gm-Cm-Am-Cm-Af-Cm-Gf-Gm-Um-Cm-Cm-Gms-Gms-Cm | 207 | 12 |

TABLE 1-continued

DV29P template-modified siRNA sequences

| unmodified sequence code | Sequence code | Sense strand sequence 5'-3' | Se-quence ID No | Corres-ponding unmodi-fied se-quence ID No | Antisense strand sequence 5'-3' | Se-quence ID No | Corres-ponding basic se-quence ID No |
|---|---|---|---|---|---|---|---|
| B418S | B418S-DV29P | Cms-Ums-Gm-Cm-Um-Af-Um-Gf-Cm-Cf-Um-Cm-Am-Um-Cm-Uf-Um-Cm-Um-Um | 106 | 6 | AmsEVP-Afs-Gm-Af-Af-Gf-Am-Um-Gm-Am-Gm-Gm-Cm-Af-Um-Af-Gm-Cm-Am-Gms-Cms-Am | 213 | 13 |
| A416 | A416-DV29P | Ums-Gms-Cm-Um-Gm-Cm-Uf-Am-Uf-Gm-Cf-Cm-Um-Cm-Am-Um-Cf-Um-Um-Cm-Um | 111 | 7 | AmsEVP-Gfs-Am-Af-Gf-Af-Um-Gm-Am-Gm-Gm-Cm-Am-Uf-Am-Gf-Cm-Am-Gm-Cm-Ams-Gms-Gm | 219 | 14 |
| A194 | A194-DV29P | Ums-Cms-Gm-Um-Gm-Um-Uf-Am-Cf-Am-Gf-Gm-Cm-Gm-Gm-Gm-Gf-Um-Um-Um-Um | 156 | 15 | AmsEVP-Afs-Am-Af-Cf-Cf-Cm-Cm-Gm-Cm-Cm-Um-Gm-Uf-Am-Af-Cm-Am-Cm-Gm-Ams-Gms-Am | 273 | 47 |
| A200 | A200-DV29P | Ums-Ams-Cm-Am-Gm-Gm-Cf-Gm-Gf-Gm-Gf-Um-Um-Um-Um-Um-Cf-Um-Um-Gm-Um | 157 | 16 | AmsEVP-Cfs-Am-Af-Gf-Af-Am-Am-Am-Am-Cm-Cm-Cm-Cf-Gm-Cf-Cm-Um-Gm-Um-Ams-Ams-Cm | 274 | 48 |
| A203 | A203-DV29P | Ams-Gms-Gm-Cm-Gm-Gm-Gf-Gm-Uf-Um-Uf-Um-Um-Cm-Um-Um-Gf-Um-Um-Gm-Am | 158 | 17 | UmsEVP-Cfs-Am-Af-Cf-Af-Am-Gm-Am-Am-Am-Am-Am-Cf-Cm-Cf-Cm-Gm-Cm-Cm-Ums-Gms-Um | 275 | 49 |
| A205 | A205-DV29P | Gms-Cms-Gm-Gm-Gm-Gm-Uf-Um-Uf-Um-Uf-Cm-Um-Um-Gm-Um-Uf-Gm-Am-Cm-Am | 116 | 18 | UmsEVP-Gfs-Um-Cf-Af-Af-Cm-Am-Am-Gm-Am-Am-Am-Af-Am-Cf-Cm-Cm-Cm-Gm-Cms-Cms-Um | 225 | 50 |
| A206 | A206-DV29P | Cms-Gms-Gm-Gm-Gm-Um-Uf-Um-Uf-Um-Cf-Um-Um-Gm-Um-Um-Gf-Am-Cm-Am-Am | 159 | 19 | UmsEVP-Ufs-Gm-Uf-Cf-Af-Am-Cm-Am-Am-Gm-Am-Am-Af-Am-Af-Cm-Cm-Cm-Cm-Gms-Cms-Cm | 276 | 51 |
| A248 | A248-DV29P | Gms-Ums-Cm-Um-Am-Gm-Af-Cm-Uf-Cm-Gf-Um-Gm-Gm-Um-Gm-Gf-Am-Cm-Um-Um | 160 | 20 | AmsEVP-Afs-Gm-Uf-Cf-Cf-Am-Cm-Cm-Am-Cm-Gm-Am-Gf-Um-Cf-Um-Am-Gm-Am-Cms-Ums-Cm | 277 | 52 |
| A255 | A255-DV29P | Cms-Ums-Cm-Gm-Um-Gm-Gf-Um-Gf-Gm-Af-Cm-Um-Um-Cm-Um-Cf-Um-Cm-Am-Am | 161 | 21 | UmsEVP-Ufs-Gm-Af-Gf-Af-Gm-Am-Am-Gm-Um-Cm-Cm-Af-Cm-Cf-Am-Cm-Gm-Am-Gms-Ums-Cm | 278 | 53 |
| A256 | A256-DV29P | Ums-Cms-Gm-Um-Gm-Gm-Uf-Gm-Gf-Am-Cf-Um-Um-Cm-Um-Cm-Uf-Cm-Am-Am-Um | 162 | 22 | AmsEVP-Ufs-Um-Gf-Af-Gf-Am-Gm-Am-Am-Gm-Um-Cm-Cf-Am-Cf-Cm-Am-Cm-Gm-Ams-Gms-Um | 279 | 54 |

TABLE 1-continued

| DV29P template-modified siRNA sequences | | | | | | | |
|---|---|---|---|---|---|---|---|
| unmodified sequence code | Sequence code | Sense strand sequence 5'-3' | Sequence ID No | Corresponding unmodified sequence ID No | Antisense strand sequence 5'-3' | Sequence ID No | Corresponding basic sequence ID No |
| A258 | A258-DV29P | Gms-Ums-Gm-Gm-Um-Gm-Gf-Am-Cf-Um-Uf-Cm-Um-Cm-Um-Cm-Af-Am-Um-Um-Um | 163 | 23 | AmsEVP-Afs-Am-Uf-Uf-Gf-Am-Gm-Am-Gm-Am-Am-Gm-Uf-Cm-Cf-Am-Cm-Cm-Am-Cms-Gms-Am | 280 | 55 |
| A259 | A259-DV29P | Ums-Gms-Gm-Um-Gm-Gm-Af-Cm-Uf-Um-Cf-Um-Cm-Um-Cm-Am-Af-Um-Um-Um-Um | 164 | 24 | AmsEVP-Afs-Am-Af-Uf-Uf-Gm-Am-Gm-Am-Gm-Am-Am-Gf-Um-Cf-Cm-Am-Cm-Cm-Ams-Cms-Gm | 281 | 56 |
| A261 | A261-DV29P | Gms-Ums-Gm-Gm-Am-Cm-Uf-Um-Cf-Um-Cf-Um-Cm-Am-Am-Um-Uf-Um-Um-Cm-Um | 126 | 25 | AmsEVP-Gfs-Am-Af-Af-Af-Um-Um-Gm-Am-Gm-Am-Gm-Af-Am-Gf-Um-Cm-Cm-Am-Cms-Cms-Am | 237 | 57 |
| A381 | A381-DV29P | Gms-Ums-Gm-Um-Cm-Um-Gf-Cm-Gf-Gm-Cf-Gm-Um-Um-Um-Um-Af-Um-Cm-Am-Um | 165 | 26 | AmsEVP-Ufs-Gm-Af-Uf-Af-Am-Am-Am-Cm-Gm-Cm-Cm-Gf-Cm-Af-Gm-Am-Cm-Am-Cms-Ams-Um | 282 | 58 |
| A413 | A413-DV29P | Ums-Cms-Cm-Um-Gm-Cm-Uf-Gm-Cf-Um-Af-Um-Gm-Cm-Cm-Um-Cf-Am-Um-Cm-Um | 166 | 27 | AmsEVP-Gfs-Am-Uf-Gf-Af-Gm-Gm-Cm-Am-Um-Am-Gm-Cf-Am-Gf-Cm-Am-Gm-Gm-Ams-Ums-Gm | 283 | 59 |
| A463 | A463-DV29P | Ams-Ums-Gm-Um-Um-Gm-Cf-Cm-Cf-Gm-Uf-Um-Um-Gm-Um-Cm-Cf-Um-Cm-Um-Am | 167 | 28 | UmsEVP-Afs-Gm-Af-Gf-Gf-Am-Cm-Am-Am-Am-Cm-Gm-Gf-Gm-Cf-Am-Am-Cm-Am-Ums-Ams-Cm | 284 | 60 |
| A536 | A536-DV29P | Cms-Ums-Gm-Cm-Um-Cm-Af-Am-Gf-Gm-Af-Am-Cm-Cm-Um-Cm-Uf-Am-Um-Gm-Um | 168 | 29 | AmsEVP-Cfs-Am-Uf-Af-Gf-Am-Gm-Gm-Um-Um-Cm-Cm-Uf-Um-Gf-Am-Gm-Cm-Am-Gms-Ums-Am | 285 | 61 |
| A707 | A707-DV29P | Ums-Ams-Gm-Gm-Gm-Cm-Uf-Um-Uf-Cm-Cf-Cm-Cm-Cm-Am-Cm-Uf-Gm-Um-Um-Um | 169 | 30 | AmsEVP-Afs-Am-Cf-Af-Gf-Um-Gm-Gm-Gm-Gm-Am-Af-Am-Gf-Cm-Cm-Cm-Um-Ams-Cms-Gm | 286 | 62 |
| A734 | A734-DV29P | Cms-Ams-Gm-Um-Um-Am-Uf-Am-Uf-Gm-Gf-Am-Um-Gm-Am-Um-Gf-Um-Gm-Gm-Um | 170 | 31 | AmsEVP-Cfs-Cm-Af-Cf-Af-Um-Cm-Am-Um-Cm-Cm-Am-Uf-Am-Uf-Am-Am-Cm-Um-Gms-Ams-Am | 287 | 63 |
| A1260 | A1260-DV29P | Cms-Ums-Gm-Cm-Cm-Gm-Af-Um-Cf-Cm-Af-Um-Am-Cm-Um-Gm-Cf-Gm-Gm-Am-Am | 171 | 32 | UmsEVP-Ufs-Cm-Cf-Gf-Cf-Am-Gm-Um-Am-Um-Gm-Gm-Af-Um-Cf-Gm-Gm-Cm-Am-Gms-Ams-Gm | 288 | 64 |

TABLE 1-continued

DV29P template-modified siRNA sequences

| unmodified sequence code | Sequence code | Sense strand sequence 5'-3' | Se-quence ID No | Corres-ponding unmodi-fied se-quence ID No | Antisense strand sequence 5'-3' | Se-quence ID No | Corres-ponding basic se-quence ID No |
|---|---|---|---|---|---|---|---|
| A1266 | A1266-DV29P | Ams-Ums-Cm-Cm-Am-Um-Af-Cm-Uf-Gm-Cf-Gm-Gm-Am-Am-Cm-Uf-Cm-Cm-Um-Am | 172 | 33 | UmsEVP-Afs-Gm-Gf-Af-Gf-Um-Um-Cm-Cm-Gm-Cm-Am-Gf-Um-Af-Um-Gm-Gm-Am-Ums-Cms-Gm | 289 | 65 |
| A1518 | A1518-DV29P | Ams-Cms-Cm-Am-Cm-Gm-Gf-Gm-Gf-Cm-Gf-Cm-Am-Cm-Cm-Um-Cf-Um-Cm-Um-Um | 173 | 34 | AmsEVP-Afs-Gm-Af-Gf-Af-Gm-Gm-Um-Gm-Cm-Gm-Cm-Cf-Cm-Cf-Gm-Um-Gm-Gm-Ums-Cms-Gm | 290 | 66 |
| A1520 | A1520-DV29P | Cms-Ams-Cm-Gm-Gm-Gm-Gf-Cm-Gf-Cm-Af-Cm-Cm-Um-Cm-Um-Cf-Um-Um-Um-Am | 174 | 35 | UmsEVP-Afs-Am-Af-Gf-Af-Gm-Am-Gm-Gm-Um-Gm-Cm-Gf-Cm-Cf-Cm-Cm-Gm-Um-Gms-Gms-Um | 291 | 67 |
| A1547 | A1547-DV29P | Cms-Ums-Cm-Cm-Cm-Cm-Gf-Um-Cf-Um-Gf-Um-Gm-Cm-Cm-Um-Uf-Cm-Um-Cm-Am | 175 | 36 | UmsEVP-Gfs-Am-Gf-Af-Af-Gm-Gm-Cm-Am-Cm-Am-Gm-Af-Cm-Gf-Gm-Gm-Gm-Am-Gms-Ums-Cm | 292 | 68 |
| A1548 | A1548-DV29P | Ums-Cms-Cm-Cm-Cm-Gm-Uf-Cm-Uf-Gm-Uf-Gm-Cm-Cm-Um-Um-Cf-Um-Cm-Am-Um | 176 | 37 | AmsEVP-Ufs-Gm-Af-Gf-Af-Am-Gm-Gm-Cm-Am-Cm-Am-Gf-Am-Cf-Gm-Gm-Gm-Gm-Ams-Gms-Um | 293 | 69 |
| B208 | B208-DV29P | Gms-Gms-Gm-Um-Um-Um-Uf-Um-Cf-Um-Uf-Gm-Um-Um-Gm-Am-Cf-Am-Am-Gm-Am | 121 | 38 | UmsEVP-Cfs-Um-Uf-Gf-Uf-Cm-Am-Am-Cm-Am-Am-Gm-Af-Am-Af-Am-Am-Cm-Cm-Cms-Cms-Gm | 231 | 70 |
| B262 | B262-DV29P | Ums-Gms-Gm-Am-Cm-Um-Uf-Cm-Uf-Cm-Uf-Cm-Am-Am-Um-Um-Uf-Um-Cm-Um-Am | 131 | 39 | UmsEVP-Afs-Gm-Af-Af-Af-Am-Um-Um-Gm-Am-Gm-Am-Gf-Am-Af-Gm-Um-Cm-Cm-Ams-Cms-Gm | 243 | 71 |
| B264 | B264-DV29P | Gms-Ams-Cm-Um-Um-Cm-Uf-Cm-Uf-Cm-Af-Am-Um-Um-Um-Um-Cf-Um-Am-Gm-Am | 136 | 40 | UmsEVP-Cfs-Um-Af-Gf-Af-Am-Am-Am-Um-Um-Gm-Am-Gf-Am-Gf-Am-Am-Gm-Um-Cms-Cms-Am | 249 | 72 |
| B1556 | B1556-DV29P | Ums-Gms-Um-Gm-Cm-Cm-Uf-Um-Cf-Um-Cf-Am-Um-Cm-Um-Gm-Cf-Cm-Gm-Gm-Am | 141 | 41 | UmsEVP-Cfs-Cm-Gf-Gf-Cf-Am-Gm-Am-Um-Gm-Am-Gm-Af-Am-Gf-Gm-Cm-Am-Cm-Ams-Gms-Am | 255 | 73 |
| B1560 | B1560-DV29P | Cms-Cms-Um-Um-Cm-Um-Cf-Am-Uf-Cm-Uf-Gm-Cm-Cm-Gm-Gm-Af-Cm-Cm-Gm-Um | 146 | 42 | AmsEVP-Cfs-Gm-Gf-Uf-Cf-Cm-Gm-Gm-Cm-Am-Gm-Am-Uf-Gm-Af-Gm-Am-Am-Gm-Gms-Cms-Am | 261 | 74 |

TABLE 1-continued

DV29P template-modified siRNA sequences

| unmodified sequence code | Sequence code | Sense strand sequence 5'-3' | Se-quence ID No | Corres-ponding unmodi-fied se-quence ID No | Antisense strand sequence 5'-3' | Se-quence ID No | Corres-ponding basic se-quence ID No |
|---|---|---|---|---|---|---|---|
| B416S | B416S-DV29P | Ums-Gms-Cm-Um-Gm-Cf-Um-Af-Um-Gf-Cm-Cm-Um-Cm-Am-Uf-Cm-Um-Um-Am | 151 | 43 | UmsEVP-Afs-Am-Gf-Af-Uf-Gm-Am-Gm-Gm-Cm-Am-Um-Af-Gm-Cf-Am-Gm-Cm-Ams-Gms-Gm | 267 | 75 |
| APC | APC-VIR | Gms-Ums-Gm-Um-Gf-Cm-Af-Cf-Uf-Um-Cm-Gm-Cm-Um-Um-Cm-Am-Cm-Am | 177 | 45 | Ums-Gfs-Um-Gm-Am-A(gna)-Gm-Cf-Gf-Am-Am-Gm-Um-Gf-Cm-Af-Cm-Am-Cms-Ums-Um | 294 | 79 |
| ANC | ANC-DV29P | Gms-Gms-Um-Cm-Um-Cm-Uf-Um-Cf-Um-Af-Um-Cm-Gm-Am-Um-Cf-Um-Um-Am-Um | 178 | 46 | AmsEVP-Ufs-Am-Af-Gf-Af-Um-Cm-Gm-Am-Um-Am-Gm-Af-Am-Gf-Am-Gm-Am-Cm-Cms-Cms-Am | 295 | 80 |

Example 2: Inhibitory Effects of DV29P Template-Modified Sequences on HBsAg and HBeAg The DV29P template-modified siRNA sequences synthesized in Example 1 were transfected into HepG2.2.15 cells using lipid nanoparticles (LNPs). The inhibitory effects of the sequences on HBsAg and HBeAg were then evaluated using ELISA.

1. Experimental Materials

Test samples: DV29P template-modified siRNA sequences listed in Table 1 (synthesized in Example 1).

Cell line: HepG2.2.15 cells.

Vehicle reagents: Sterile nuclease-free water and Gibco™ Opti-MEM™ (Thermo Fisher Scientific).

2. Experimental Methods

The inhibitory effects of the test samples on HBsAg and HBeAg in HepG2.2.15 cells were assessed using ELISA.

2.1 Cell Culture

Subculture: HepG2.2.15 cells were subcultured in DIEM/F12 medium containing 10% fetal bovine serum, 370 μg/mL Geneticin, 1% L-glutamine, 1% non-essential amino acids, and 1% penicillin-streptomycin. The cells were maintained in a cell incubator at 37° C. with 5% $CO_2$ and subcultured every three days. For subculturing, the cells were detached using 0.25% trypsin, centrifuged at 800 rpm for 3 minutes, and the supernatant was discarded. Fresh medium was then added for further subculture.

Plating: HepG2.2.15 cells were plated in DMEM/F12 medium containing 10% fetal bovine serum (FBS), 1% L-glutamine, 1% non-essential amino acids, and 1% penicillin-streptomycin.

2.2 Cell Transfection

Preparation of transfection mixture: Lipofectamine™ RNAiMAX (Thermo Fisher Scientific) and Opti-MEM were mixed in a 2:98 ratio and vortexed thoroughly.

Preparation of transfection complex: 30 μL of siRNA solution diluted in Opti-MEM was combined with 30 μL of the transfection mixture at a 1:1 (v/v) ratio, vortexed, and incubated at room temperature for 15 minutes to form the transfection complex.

Preparation of control transfection reagent: 15 μL of the prepared transfection mixture was added to 15 μL of Opti-MEM. The mixture was vortexed and then incubated at room temperature for 15 minutes.

The prepared transfection complex was added to a 96-well cell culture plate (15 μL per well, with three replicates per sequence), resulting in a final siRNA concentration of 0.3 nM per well. 135 μL of cell suspension (containing $2.25\times10^4$ cells) was added to each well. After mixing using the cross-mixing method, the plate was placed in a 37° C., 5% $CO_2$ cell incubator for incubation.

2.3 Detection of HBsAg and HBeAg in Cell Supernatant

1) Collection of Cell Supernatant a. On day 3 post-transfection, the culture medium was replaced by removing the cell supernatant and adding 150 μL/well of fresh medium for continued culture.

b. On day 6 post-transfection, the cell supernatant was collected for the detection of HBsAg and HBeAg levels.

2) Quantitative Detection of HBsAg and HBeAg

The concentrations of HBsAg and HBeAg were measured using the Hepatitis B Virus E Antigen Detection Kit (Autobio CL0310) and the Hepatitis B Virus Surface Antigen Detection Kit (Autobio CL0312). The specific steps are as follows:

a. The kits and test samples were equilibrated to room temperature.

b. Test samples, standards, negative controls, and positive controls were added to the plate wells at 50 μL each.

c. 50 μL of enzyme conjugate was added to each well. After thorough mixing, the plate was incubated at 37° C. for 60 minutes.

d. The liquid in the wells was removed, and the plate was washed 5 times with wash buffer. Finally, the plate was patted dry on absorbent paper.

e. Luminescent substrates A and B were mixed in equal proportions, and added at 50 μL/well, followed by a 3-minute incubation at room temperature in the dark.

f. The luminescence values were measured using a microplate reader.

2.4 Data Processing

The inhibition rates of HBsAg and HBeAg were calculated using the following formulas:

$$HBsAg\ \text{inhibition rate (\%)} = \left(1 - HBsAg\ \text{expression level of sample}/HBsAg\ \text{expression level of transfection control in the same plate}\right) \times 100\%;$$

$$HBeAg\ \text{inhibition rate (\%)} = \left(1 - HBeAg\ \text{expression level of sample}/HBeAg\ \text{expression level of transfection control in the same plate}\right) \times 100\%.$$

The relative inhibition rate of HBsAg compared to the positive control (with the positive control inhibition rate set as 1)=HBsAg inhibition rate of sample (%)/HBsAg inhibition rate of positive control in the same plate (%). It should be noted that a value greater than 1 indicates that the sequence has a better inhibitory effect on HBsAg than the positive control, while a value less than 1 indicates that the sequence has a lower inhibitory efficiency on HBsAg compared to the positive control.

The relative inhibition rate of HBeAg compared to the positive control (with the positive control inhibition rate set as 1)=HBeAg inhibition rate of sample (%)/HBeAg inhibition rate of positive control in the same plate (%). It should be noted that a value greater than 1 indicates that the sequence has a better inhibitory effect on HBeAg than the positive control, while a value less than 1 indicates that the sequence has a lower inhibitory efficiency on HBeAg compared to the positive control.

2.5 IC50 Experiment

In this experiment, the concentration of each sequence started at 10 nM, and was diluted 4-fold serially, resulting in 8 concentration points (10 nM, 2.5 nM, 0.625 nM, 0.15625 nM, 39.06 pM, 9.77 pM, 2.44 pM, and 0.61 pM). The inhibition rates of each sequence at these concentrations were measured, plotted, and used to calculate the IC50 values for each sequence and the positive control.

2.6 Cytotoxicity Assay

During the IC50 experiment, after collecting the cell supernatant, cell viability was measured using the CellTiter-Glo® (Promega) kit. The method is briefly described as follows: The CellTiter-Glo reagent was mixed with the culture medium at a 1:1 ratio, and 100 μL was added to each well. After incubating at room temperature for 10 minutes, the luminescence signal was measured using a microplate reader.

The cell viability was calculated using the formula:

$$\text{cell viability (\%)} = (\text{sample signal value} - \text{average blank control value})/(\text{average transfection control value} - \text{average blank control value}) \times 100\%.$$

3. Experimental Results

The experimental results demonstrated that the sequences B207S-DV29P, B1572-DV29P, B1575-DV29P, B418S-DV29P, A206-DV29P, A416-DV29P, A1548-DV29P, A1550-DV29P, and A1573-DV29P exhibited significantly superior inhibitory effects on HBsAg compared to other sequences, as well as significantly better inhibitory effects on HBeAg compared to other sequences.

The inhibition rates of each sequence on the expression of HBsAg and HBeAg at a single concentration, as well as their relative inhibition rates compared to the positive control sequence APC-VIR, are shown in Tables 3, 4, 5, and 6.

The single-concentration screening results indicated that certain sequences modified with the template DV29P, including B207S-DV29P, B1572-DV29P, B1575-DV29P, B418S-DV29P, A206-DV29P, A416-DV29P, A1548-DV29P, A1550-DV29P, and A1573-DV29P (specific sequences are listed in Table 2), ranked higher in terms of inhibition rates for both HBsAg and HBeAg compared to the positive control APC-VIR.

The IC50 experimental results and cytotoxicity results for each sequence are as shown in Table 7. The IC50 results demonstrated that the 11 candidate sequences modified with the template DV29P designed in the present disclosure exhibited IC50 values for HBsAg ranging from 0.01 to 0.08 nM, all of which were superior to the positive control's IC50 value of 0.1777 nM. For example, the IC50 values for A261-DV29P, A1573-DV29P, and A206-DV29P were 0.0169 nM, 0.0226 nM, and 0.0226 nM, respectively. These sequences effectively inhibited HBsAg expression at low concentrations. For HBeAg, the IC50 values of these 11 candidate sequences ranged from 0.06 to 0.4 nM, all of which were superior to the positive control's IC50 value of 0.7685 nM. For example, the IC50 values for A1573-DV29P, A206-DV29P, and A1550-DV29P were 0.0684 nM, 0.1105 nM, and 0.1202 nM, respectively. The cytotoxicity results showed that among the 11 sequences, except for sequence A416-DV29P, which exhibited a cell viability of 81.82% at the highest tested concentration of 10 nM, all other sequences demonstrated cell viabilities greater than 90%, indicating no significant cytotoxicity. This suggests that the sequences have a wide concentration range for selection.

The selection criteria prioritized the inhibitory effect on HBsAg while also considering the inhibitory effect on HBeAg. Based on the comprehensive results, 9 sequences were selected from the 11 for further optimization and design. The sequences B207S-DV29P, B1572-DV29P, B1575-DV29P, B418S-DV29P, A206-DV29P, A416-DV29P, A1548-DV29P, A1550-DV29P, and A1573-DV29P were identified as candidate sequences.

TABLE 2 siRNA sequences with superior inhibition rates for HBsAg and HBeAg compared to the positive control

| Sequence code | Sense strand sequence 5'-3' | Sequence ID No | Unmodified sequence ID No. | Antisense strand sequence 5'-3' | Sequence ID No. | Unmodified sequence ID No. |
|---|---|---|---|---|---|---|
| B207S-DV29P | Gms-Gms-Gm-Gm-Um-Uf-Um-Uf-Um-Cf-Um-Um-Gm-Um-Um-Gf-Am-Cm-Am-Am | 81 | 1 | UmsEVP-Ufs-Gm-Uf-Cf-Af-Am-Cm-Am-Am-Gm-Am-Am-Af-Am-Af-Cm-Cm-Cm-Cms-Gms-Cm | 179 | 8 |
| B1572-DV29P | Cms-Cms-Gm-Gm-Am-Cm-Cf-Gm-Uf-Gm-Uf-Gm-Cm-Am-Cm-Um-Uf-Cm-Gm-Cm-Um | 91 | 3 | AmsEVP-Gfs-Cm-Gf-Af-Af-Gm-Um-Gm-Cm-Am-Cm-Am-Cf-Gm-Gf-Um-Cm-Cm-Gm-Gms-Cms-Am | 195 | 10 |
| B1575-DV29P | Gms-Ams-Cm-Cm-Gm-Um-Gf-Um-Gf-Cm-Af-Cm-Um-Um-Cm-Gm-Cf-Um-Um-Cm-Am | 96 | 4 | UmsEVP-Gfs-Am-Af-Gf-Cf-Gm-Am-Am-Gm-Um-Gm-Cm-Af-Cm-Af-Cm-Gm-Gm-Um-Cms-Cms-Gm | 201 | 11 |
| B418S-DV29P | Cms-Ums-Gm-Cm-Um-Af-Um-Gf-Cm-Cf-Um-Cm-Am-Um-Cm-Uf-Um-Cm-Um-Um | 106 | 6 | AmsEVP-Afs-Gm-Af-Af-Gf-Am-Um-Gm-Am-Gm-Gm-Cm-Af-Um-Af-Gm-Cm-Am-Gms-Cms-Am | 213 | 13 |
| A206-DV29P | Cms-Gms-Gm-Gm-Gm-Um-Uf-Um-Uf-Um-Cf-Um-Um-Gm-Um-Um-Gf-Am-Cm-Am-Am | 159 | 19 | UmsEVP-Ufs-Gm-Uf-Cf-Af-Am-Cm-Am-Am-Gm-Am-Am-Af-Am-Af-Cm-Cm-Cm-Cm-Gms-Cms-Cm | 276 | 51 |
| A416-DV29P | Ums-Gms-Cm-Um-Gm-Cm-Uf-Am-Uf-Gm-Cf-Cm-Um-Cm-Am-Um-Cf-Um-Um-Cm-Um | 111 | 7 | AmsEVP-Gfs-Am-Af-Gf-Af-Um-Gm-Am-Gm-Gm-Cm-Am-Uf-Am-Gf-Cm-Am-Gm-Cm-Ams-Gms-Gm | 219 | 14 |
| A1548-DV29P | Ums-Cms-Cm-Cm-Cm-Gm-Uf-Cm-Uf-Gm-Uf-Gm-Cm-Cm-Um-Um-Cf-Um-Cm-Am-Um | 176 | 37 | AmsEVP-Ufs-Gm-Af-Gf-Af-Am-Gm-Gm-Cm-Am-Cm-Am-Gf-Am-Cf-Gm-Gm-Gm-Gm-Ams-Gms-Um | 293 | 69 |
| A1550-DV29P | Cms-Cms-Cm-Gm-Um-Cm-Uf-Gm-Uf-Gm-Cf-Cm-Um-Um-Cm-Um-Cf-Am-Um-Cm-Um | 86 | 2 | AmsEVP-Gfs-Am-Uf-Gf-Af-Gm-Am-Am-Gm-Gm-Cm-Am-Cf-Am-Gf-Am-Cm-Gm-Gm-Gms-Gms-Am | 187 | 9 |
| A1573-DV29P | Cms-Gms-Gm-Am-Cm-Cm-Gf-Um-Gf-Um-Gf-Cm-Am-Cm-Um-Um-Cf-Gm-Cm-Um-Um | 101 | 5 | AmsEVP-Afs-Gm-Cf-Gf-Af-Am-Gm-Um-Gm-Cm-Am-Cm-Af-Cm-Gf-Gm-Um-Cm-Cm-Gms-Gms-Cm | 207 | 12 |

(i) Inhibition of HBV Gene Expression by Sequences Modified with the DV29P Template at a Single Concentration (1) Sequences exhibiting superior inhibition of HBsAg compared to the positive control are shown in Table 3, including B207S-DV29P, B1575-DV29P, B1572-DV29P, B418S-DV29P, A261-DV29P, A206-DV29P, A1550-DV29P, A1573-DV29P, A1548-DV29P, and A416-DV29P Among these, the four sequences B207S-DV29P, B1575-DV29P, B1572-DV29P, and B418S-DV29P demonstrated HBsAg inhibition rates exceeding 80% at a concentration of 0.3 nM. For example, B207S-DV29P achieved an inhibition rate of 93.37%, which is 23.59% higher than that of the positive control.

TABLE 3

DV29P-modified sequences with higher inhibition rates for HBsAg compared to the positive control

| Sequence code | HBsAg inhibition rate (%) | Relative inhibition rate (positive control set as 1) | Increase % over positive control |
|---|---|---|---|
| B207S-DV29P | 93.37 | 1.34 | 23.59 |
| B1575-DV29P | 88.62 | 1.27 | 18.84 |
| B1572-DV29P | 80.95 | 1.16 | 11.17 |
| B418S-DV29P | 80.25 | 1.15 | 10.47 |
| A261-DV29P | 73.97 | 1.06 | 4.19 |
| A206-DV29P | 73.97 | 1.06 | 4.19 |
| A1550-DV29P | 73.97 | 1.06 | 4.19 |
| A1548-DV29P | 72.57 | 1.04 | 2.79 |
| A1573-DV29P | 71.87 | 1.03 | 2.09 |
| A1260-DV29P | 71.87 | 1.03 | 2.09 |
| A416-DV29P | 71.18 | 1.02 | 1.4 |
| A203-DV29P | 70.48 | 1.01 | 0.7 |
| A1547-DV29P | 70.48 | 1.01 | 0.7 |
| APC-VIR | 69.78 | 1 | 0 |

(2) Sequences exhibiting inferior inhibition of HBsAg compared to the positive control are shown in Table 4. For example, the sequence B416S-DV29P showed an HBsAg inhibition rate of only 6.98%.

TABLE 4

DV29P-modified sequences with lower inhibition rates for HBsAg compared to the positive control

| Sequence code | HBsAg inhibition rate (%) | Relative inhibition rate (positive control set as 1) |
|---|---|---|
| APC-VIR | 69.78 | 1 |
| A205-DV29P | 68.38 | 0.98 |
| A200-DV29P | 66.99 | 0.96 |
| A259-DV29P | 58.62 | 0.84 |
| A734-DV29P | 57.22 | 0.82 |
| A255-DV29P | 57.22 | 0.82 |
| A256-DV29P | 54.43 | 0.78 |
| A258-DV29P | 54.43 | 0.78 |
| A248-DV29P | 54.43 | 0.78 |
| B264-DV29P | 51.64 | 0.74 |
| B1560-DV29P | 47.45 | 0.68 |
| B208-DV29P | 46.75 | 0.67 |
| A1266-DV29P | 45.36 | 0.65 |
| B262-DV29P | 43.96 | 0.63 |
| B1556-DV29P | 42.57 | 0.61 |
| A413-DV29P | 38.38 | 0.55 |
| A463-DV29P | 38.38 | 0.55 |
| A536-DV29P | 36.98 | 0.53 |
| A707-DV29P | 31.40 | 0.45 |
| A1518-DV29P | 21.63 | 0.31 |
| A1520-DV29P | 14.65 | 0.21 |
| B416S-DV29P | 6.98 | 0.1 |
| A194-DV29P | −4.19 | −0.06 |
| A381-DV29P | −6.98 | −0.1 |

(3) Sequences exhibiting superior inhibition of HBeAg compared to the positive control are shown in Table 5. Among these, B1575-DV29P, B207S-DV29P, B1572-DV29P, and B418S-DV29P ranked the highest, outperforming the positive control by 38.62%, 22.07%, 17.10%, and 13.24%, respectively.

TABLE 5

DV29P-modified sequences with higher inhibition rates for HBeAg compared to the positive control

| Sequence code | HBeAg inhibition rate (%) | Relative inhibition rate (positive control set as 1) | Increase % over positive control |
|---|---|---|---|
| B1575-DV29P | 66.21 | 2.4 | 38.62 |
| B207S-DV29P | 49.66 | 1.8 | 22.07 |
| B1572-DV29P | 44.69 | 1.62 | 17.10 |
| B418S-DV29P | 40.83 | 1.48 | 13.24 |
| A1550-DV29P | 39.45 | 1.43 | 11.86 |
| A536-DV29P | 38.35 | 1.39 | 10.76 |
| A206-DV29P | 37.24 | 1.35 | 9.65 |
| A416-DV29P | 35.04 | 1.27 | 7.45 |
| A1573-DV29P | 34.76 | 1.26 | 7.17 |
| A381-DV29P | 32.83 | 1.19 | 5.24 |
| A1548-DV29P | 32.55 | 1.18 | 4.96 |
| A1260-DV29P | 32 | 1.16 | 4.41 |
| A1547-DV29P | 32 | 1.16 | 4.41 |
| A734-DV29P | 31.17 | 1.13 | 3.58 |
| A463-DV29P | 30.07 | 1.09 | 2.48 |
| A205-DV29P | 29.79 | 1.08 | 2.20 |
| A261-DV29P | 28.42 | 1.03 | 0.83 |
| APC-VIR | 27.59 | 1 | 0 |

(4) Sequences exhibiting inferior inhibition of HBeAg compared to the positive control are shown in Table 6. For example, the sequence A1520-DV29P showed an inhibition rate of only 0.28% at a concentration of 0.3 nM.

TABLE 6

DV29P-modified sequences with lower inhibition rates for HBeAg compared to the positive control

| Sequence code | HBeAg inhibition rate (%) | Relative inhibition rate (positive control set as 1) |
|---|---|---|
| APC-VIR | 27.59 | 1 |
| A200-DV29P | 25.66 | 0.93 |
| A203-DV29P | 25.38 | 0.92 |
| B208-DV29P | 25.38 | 0.92 |
| A255-DV29P | 23.45 | 0.85 |
| A413-DV29P | 22.90 | 0.83 |
| A258-DV29P | 19.59 | 0.71 |
| A256-DV29P | 19.04 | 0.69 |
| A1266-DV29P | 16.83 | 0.61 |
| A707-DV29P | 16.28 | 0.59 |
| B1560-DV29P | 15.72 | 0.57 |
| B262-DV29P | 15.45 | 0.56 |
| B1556-DV29P | 14.35 | 0.52 |
| A259-DV29P | 12.14 | 0.44 |
| B264-DV29P | 11.59 | 0.42 |
| A248-DV29P | 9.66 | 0.35 |
| B416S-DV29P | 9.66 | 0.35 |
| A1518-DV29P | 4.14 | 0.15 |
| A194-DV29P | 2.21 | 0.08 |
| A1520-DV29P | 0.28 | 0.01 |

(ii) IC50 Experiment and Cytotoxicity Results

Nine sequences that demonstrated excellent performance in the single-concentration experiment, including B207S-DV29P, B1572-DV29P, B1575-DV29P, B418S-DV29P, A206-DV29P, A416-DV29P, A1548-DV29P, A1550-DV29P, and A1573-DV29P, were selected for IC50 experiments. The results showed that the IC50 values of these candidate sequences for both HBsAg and HBeAg were lower than those of the positive control, confirming their superior inhibitory effects. For HBsAg, A261-DV29P, A1573-DV29P, and A206-DV29P had IC50 values of 0.019 nM, 0.022 nM, and 0.024 nM, respectively. For HBeAg, A1573-DV29P, B207S-DV29P, A206-DV29P, and A1550-DV29P had IC50 values of 0.079 nM, 0.093 nM, 0.115 nM, and 0.138 nM, respectively. Detailed results are shown in Table 7.

The cytotoxicity results showed that among these sequences, except for sequence A416-DV29P, which exhibited a cell viability of 81.82% at the highest tested concentration of 10 nM, all other sequences demonstrated cell viabilities greater than 90%, indicating no significant cytotoxicity. This suggests that the sequences have a wide concentration range for selection. Detailed results are shown in Table 7.

TABLE 7

IC50 experiment results for HBsAg and HBeAg

| Sequence code | IC50 (nM) HBsAg | IC50 (nM) HBeAg | CC50 (nM) | Cell viability at 10 nM (%) |
|---|---|---|---|---|
| A261-DV29P | 0.019 | 0.466 | >10 | 120.22 |
| A1573-DV29P | 0.022 | 0.079 | >10 | 91.90 |
| A1550-DV29P | 0.024 | 0.138 | >10 | 117.93 |
| A206-DV29P | 0.026 | 0.115 | >10 | 121.59 |
| B207S-DV29P | 0.027 | 0.093 | >10 | 107.19 |
| A416-DV29P | 0.040 | 0.146 | >10 | 81.82 |
| A1260-DV29P | 0.054 | 0.243 | >10 | 107.40 |
| B1575-DV29P | 0.062 | 0.283 | >10 | 93.09 |
| A1548-DV29P | 0.076 | 0.570 | >10 | 108.60 |
| APC-VIR | 0.168 | 0.936 | >10 | 101.21 |

Example 3: Inhibition of HBV Gene Expression by Unmodified Sequences

In this example, unmodified sequences corresponding to the modified sequences in Example 1 were synthesized and transfected into HepG2.2.15 cells using lipid nanoparticles (LNPs). The inhibitory effects of these sequences on HBsAg and HBeAg were detected using ELI SA technology to screen for unmodified siRNA sequences with favorable inhibitory effects.

1. Experimental Materials

Test Samples:

Unmodified small interfering RNA (siRNA) sequences listed in Table 8. All sequences were synthesized according to the methods described in Example 1.

TABLE 8

Unmodified siRNA sequences

| Sequence code | Sense strand sequence 5'-3' | Sequence ID No | Antisense strand sequence 5'-3' | Sequence ID No |
|---|---|---|---|---|
| B207S | GGGGUUUUUCUUGUUGACAA | 1 | UUGUCAACAAGAAAAACCCCGC | 8 |
| A1550 | CCCGUCUGUGCCUUCUCAUCU | 2 | AGAUGAGAAGGCACAGACGGGGA | 9 |
| B1572 | CCGGACCGUGUGCACUUCGCU | 3 | AGCGAAGUGCACACGGUCCGGCA | 10 |
| B1575 | GACCGUGUGCACUUCGCUUCA | 4 | UGAAGCGAAGUGCACACGGUCCG | 11 |

TABLE 8-continued

Unmodified siRNA sequences

| Sequence code | Sense strand sequence 5'-3' | Sequence ID No | Antisense strand sequence 5'-3' | Sequence ID No |
|---|---|---|---|---|
| A1573 | CGGACCGUGUGCACUUCGCUU | 5 | AAGCGAAGUGCACACGGUCCGGC | 12 |
| B418S | CUGCUAUGCCUCAUCUUCUU | 6 | AAGAAGAUGAGGCAUAGCAGCA | 13 |
| A416 | UGCUGCUAUGCCUCAUCUUCU | 7 | AGAAGAUGAGGCAUAGCAGCAGG | 14 |
| A194 | UCGUGUUACAGGCGGGGUUUU | 15 | AAAACCCCGCCUGUAACACGAGA | 47 |
| A200 | UACAGGCGGGGUUUUUCUUGU | 16 | ACAAGAAAAACCCGCCUGUAAC | 48 |
| A203 | AGGCGGGGUUUUUCUUGUUGA | 17 | UCAACAAGAAAAACCCCGCCUGU | 49 |
| A205 | GCGGGGUUUUUCUUGUUGACA | 18 | UGUCAACAAGAAAAACCCCGCCU | 50 |
| A206 | CGGGGUUUUUCUUGUUGACAA | 19 | UUGUCAACAAGAAAAACCCCGCC | 51 |
| A248 | GUCUAGACUCGUGGUGGACUU | 20 | AAGUCCACCACGAGUCUAGACUC | 52 |
| A255 | CUCGUGGUGGACUUCUCUCAA | 21 | UUGAGAGAAGUCCACCACGAGUC | 53 |
| A256 | UCGUGGUGGACUUCUCUCAAU | 22 | AUUGAGAGAAGUCCACCACGAGU | 54 |
| A258 | GUGGUGGACUUCUCUCAAUUU | 23 | AAAUUGAGAGAAGUCCACCACGA | 55 |
| A259 | UGGUGGACUUCUCUCAAUUUU | 24 | AAAAUUGAGAGAAGUCCACCACG | 56 |
| A261 | GUGGACUUCUCUCAAUUUUCU | 25 | AGAAAAUUGAGAGAAGUCCACCA | 57 |
| A381 | GUGUCUGCGGCGUUUUAUCAU | 26 | AUGAUAAAACGCCGCAGACACAU | 58 |
| A413 | UCCUGCUGCUAUGCCUCAUCU | 27 | AGAUGAGGCAUAGCAGCAGGAUG | 59 |
| A463 | AUGUUGCCCGUUUGUCCUCUA | 28 | UAGAGGACAAACGGGCAACAUAC | 60 |
| A536 | CUGCUCAAGGAACCUCUAUGU | 29 | ACAUAGAGGUUCCUUGAGCAGUA | 61 |
| A707 | UAGGGCUUUCCCCCACUGUUU | 30 | AAACAGUGGGGGAAAGCCCUACG | 62 |
| A734 | CAGUUAUAUGGAUGAUGUGGU | 31 | ACCACAUCAUCCAUAUAACUGAA | 63 |
| A1260 | CUGCCGAUCCAUACUGCGGAA | 32 | UUCCGCAGUAUGGAUCGGCAGAG | 64 |
| A1266 | AUCCAUACUGCUGGAACCCUA | 33 | UAGGAGUUCCGCAGUAUGGAUCG | 65 |
| A1518 | ACCACGGGGCGCACCUCUCUU | 34 | AAGAGAGGUGCGCCCCGUGGUCG | 66 |
| A1520 | CACGGGGCGCACCUCUCUUUA | 35 | UAAAGAGAGGUGCGCCCCGUGGU | 67 |

TABLE 8-continued

| Unmodified siRNA sequences | | | | |
|---|---|---|---|---|
| Sequence code | Sense strand sequence 5'-3' | Sequence ID No | Antisense strand sequence 5'-3' | Sequence ID No |
| A1547 | CUCCCCGUCUGUGCCUUCUCA | 36 | UGAGAAGGCACAGACGGGGAGUC | 68 |
| A1548 | UCCCCGUCUGUGCCUUCUCAU | 37 | AUGAGAAGGCACAGACGGGGAGU | 69 |
| B208 | GGGUUUUUCUUGUUGACAAGA | 38 | UCUUGUCAACAAGAAAAACCCCG | 70 |
| B262 | UGGACUUCUCUCAAUUUUCUA | 39 | UAGAAAAUUGAGAGAAGUCCACG | 71 |
| B264 | GACUUCUCUCAAUUUUCUAGA | 40 | UCUAGAAAAUUGAGAGAAGUCCA | 72 |
| B1556 | UGUGCCUUCUCAUCUGCCGGA | 41 | UCCGGCAGAUGAGAAGGCACAGA | 73 |
| B1560 | CCUUCUCAUCUGCCGGACCGU | 42 | ACGGUCCGGCAGAUGAGAAGGCA | 74 |
| B416S | UGCUGCUAUGCCUCAUCUUA | 43 | UAAGAUGAGGCAUAGCAGCAGG | 75 |
| APC | GUGUGCACUUCGCUUCACA | 45 | UGUGAAGCGAAGUGCACACUU | 79 |
| ANC | GGUCUCUUCUAUCGAUCUUAU | 46 | AUAAGAUCGAUAGAAGAGACCCA | 80 |

Cell line: HepG2.2.15 cells.

Vehicle reagents: Sterile nuclease-free water and Gibco™ Opti-IVEM™.

2. Experimental Methods

Referring to Example 2, the screening concentration was set at 0.3 nM.

3. Experimental Results

The experimental results demonstrated that the sequences B207S, B1572, B1575, 1B418S, A206, A416, A1548, A1550, and A1573 exhibited significantly superior inhibitory effects on HBsAg compared to other sequences, as well as significantly better inhibitory effects on HBeAg compared to other sequences.

Sequences exhibiting superior inhibition rates of HBsAg and HBeAg at a single concentration compared to the positive control are shown in Table 9, including B207S, B1575, B418S, A1573, B1572, A261, A206, A1550, A416, and A1548. Among these, B207S achieved inhibition rates of 77.02% for HBsAg and 40.74% for HBeAg, significantly outperforming the positive control sequence APC, which showed inhibition rates of 61.45% for HBsAg and 20.85% for HBeAg.

TABLE 9

| unmodified sequences with higher inhibition rates for HBsAg and HBeAg compared to the positive control | | |
|---|---|---|
| Sequence code | HBsAg inhibition rate (%) | HBeAg inhibition rate (%) |
| B207S | 77.02 | 40.74 |
| B1575 | 73.89 | 45.03 |
| B418S | 69.64 | 34.13 |
| A1573 | 66.81 | 23.74 |
| B1572 | 66.31 | 36.42 |
| A261 | 66.26 | 22.06 |
| A206 | 65.50 | 31.79 |
| A1550 | 65.57 | 27.08 |
| A416 | 63.78 | 24.35 |
| A1548 | 62.62 | 27.22 |
| APC | 61.45 | 20.85 |

Example 4: Inhibition of HBsAg and HBeAg by Sequences Modified with Different Templates In this example, 15 unmodified sequences—A205, B208, B207S, A261, B262, B264, A1550, B1556, B1560, B1575, A1573, B1572, B418S, A416, and B416S-were modified using 8 templates designed in the present disclosure (DV25P, DV26P, DV27P, DV28P, DV29P, DV32P, DV33P, and DV34P) as well as templates disclosed in prior art (DV30P, DV31P, DV21P, and DV22P), resulting in a total of 154 modified sequences. These sequences were transfected into HepG2.2.15 cells using lipid nanoparticles (LNPs), and their inhibitory effects on HBsAg and HBeAg were evaluated using ELISA technology.

1. Experimental Materials

Test Samples: Sequences obtained by modifying 15 siRNA unmodified sequences using different templates (DV25P, DV26P, DV27P, DV28P, DV29P, DV32P, DV33P, DV34P, DV30P, DV31P, DV21P, and DV22P) are shown in Table 11. The synthesis methods followed those described in Example 1.

Cell line: HepG2.2.15 cells.

Vehicle reagents: Sterile nuclease-free water and Gibco™ Opti-MEM.

The modification principles for the disclosed templates are as follows:

When the antisense strand is 23 nucleotides in length, the antisense strand is modified using one or a combination of two or more modification patterns as shown in Table 10-1:

TABLE 10-1

| Antisense strand modification patterns Antisense strand (AS) 5'-3' | | | | | | | | | | | | |
|---|---|---|---|---|---|---|---|---|---|---|---|---|
| No. | 1 | 2 | 3 | 4 | 5 | 6 | 7 | 8 | 9 | 10 | 11 | 12 |
| A | 2'-OMe + PS + EVP | 2'-F + PS | 2'-OMe | 2'-F | 2'-F | 2'-F | 2'-OMe | 2'-OMe | 2'-OMe | 2'-OMe | 2'-OMe | 2'-OMe |
| B | 2'-OMe + PS + EVP | 2'-F + PS | 2'-F | 2'-F | 2'-OMe | 2'-F | 2'-OMe | 2'-OMe | 2'-OMe | 2'-OMe | 2'-OMe | 2'-OMe |
| C | 2'-OMe + PS + EVP | 2'-F + PS | 2'-OMe | 2'-OMe | 2'-F | 2'-F | 2'-OMe | 2'-OMe | 2'-OMe | 2'-OMe | 2'-OMe | 2'-OMe |

TABLE 10-1-continued

| Antisense strand modification patterns Antisense strand (AS) 5'-3' | | | | | | | | | | | |
|---|---|---|---|---|---|---|---|---|---|---|---|
| D | 2'-OMe + PS + EVP | 2'-F + PS | 2'-F | 2'-OMe | 2'-OMe | 2'-F | 2'-OMe | 2'-OMe | 2'-OMe | 2'-OMe | 2'-OMe | 2'-OMe |
| E | 2'-OMe + PS + EVP | 2'-F + PS | 2'-OMe | 2'-OMe | 2'-OMe | 2'-F | 2'-OMe | 2'-OMe | 2'-OMe | 2'-OMe | 2'-OMe | 2'-OMe |
| F | 2'-OMe + PS + EVP | 2'-F + PS | 2'-F | 2'-OMe | 2'-F | 2'-F | 2'-OMe | 2'-OMe | 2'-OMe | 2'-OMe | 2'-OMe | 2'-OMe |

| No. | 13 | 14 | 15 | 16 | 17 | 18 | 19 | 20 | 21 | 22 | 23 |
|---|---|---|---|---|---|---|---|---|---|---|---|
| A | 2'-OMe | 2'-F | 2'-OMe | 2'-F | 2'-OMe | 2'-OMe | 2'-OMe | 2'-OMe | 2'-OMe + PS | 2'-OMe + PS | 2'-OMe |
| B | 2'-OMe | 2'-F | 2'-OMe | 2'-F | 2'-OMe | 2'-OMe | 2'-OMe | 2'-OMe | 2'-OMe + PS | 2'-OMe + PS | 2'-OMe |
| C | 2'-OMe | 2'-F | 2'-OMe | 2'-F | 2'-OMe | 2'-OMe | 2'-OMe | 2'-OMe | 2'-OMe + PS | 2'-OMe + PS | 2'-OMe |
| D | 2'-OMe | 2'-F | 2'-OMe | 2'-F | 2'-OMe | 2'-OMe | 2'-OMe | 2'-OMe | 2'-OMe + PS | 2'-OMe + PS | 2'-OMe |
| E | 2'-OMe | 2'-F | 2'-OMe | 2'-F | 2'-OMe | 2'-OMe | 2'-OMe | 2'-OMe | 2'-OMe + PS | 2'-OMe + PS | 2'-OMe |
| F | 2'-OMe | 2'-F | 2'-OMe | 2'-F | 2'-OMe | 2'-OMe | 2'-OMe | 2'-OMe | 2'-OMe + PS | 2'-OMe + PS | 2'-OMe |

When the antisense strand is 22 nucleotides in length, the antisense strand is modified using one or a combination of two or more modification patterns as shown in Table 10-2:

TABLE 10-2

| Antisense strand modification patterns Antisense strand (AS) 5'-3' | | | | | | | | | | | |
|---|---|---|---|---|---|---|---|---|---|---|---|
| No. | 1 | 2 | 3 | 4 | 5 | 6 | 7 | 8 | 9 | 10 | 11 |
| A | 2'-OMe + PS + EVP | 2'-F + PS | 2'-OMe | 2'-F | 2'-F | 2'-F | 2'-OMe | 2'-OMe | 2'-OMe | 2'-OMe | 2'-OMe |
| B | 2'-OMe + PS + EVP | 2'-F + PS | 2'-F | 2'-F | 2'-OMe | 2'-F | 2'-OMe | 2'-OMe | 2'-OMe | 2'-OMe | 2'-OMe |
| C | 2'-OMe + PS + EVP | 2'-F + PS | 2'-OMe | 2'-OMe | 2'-F | 2'-F | 2'-OMe | 2'-OMe | 2'-OMe | 2'-OMe | 2'-OMe |
| D | 2'-OMe + PS + EVP | 2'-F + PS | 2'-F | 2'-OMe | 2'-OMe | 2'-F | 2'-OMe | 2'-OMe | 2'-OMe | 2'-OMe | 2'-OMe |
| E | 2'-OMe + PS + EVP | 2'-F + PS | 2'-OMe | 2'-OMe | 2'-OMe | 2'-F | 2'-OMe | 2'-OMe | 2'-OMe | 2'-OMe | 2'-OMe |
| F | 2'-OMe + PS + EVP | 2'-F + PS | 2'-F | 2'-OMe | 2'-F | 2'-F | 2'-OMe | 2'-OMe | 2'-OMe | 2'-OMe | 2'-OMe |

| No. | 12 | 13 | 14 | 15 | 16 | 17 | 18 | 19 | 20 | 21 | 22 |
|---|---|---|---|---|---|---|---|---|---|---|---|
| A | 2'-OMe | 2'-OMe | 2'-F | 2'-OMe | 2'-F | 2'-OMe | 2'-OMe | 2'-OMe | 2'-OMe + PS | 2'-OMe + PS | 2'-OMe |
| B | 2'-OMe | 2'-OMe | 2'-F | 2'-OMe | 2'-F | 2'-OMe | 2'-OMe | 2'-OMe | 2'-OMe + PS | 2'-OMe + PS | 2'-OMe |
| C | 2'-OMe | 2'-OMe | 2'-F | 2'-OMe | 2'-F | 2'-OMe | 2'-OMe | 2'-OMe | 2'-OMe + PS | 2'-OMe + PS | 2'-OMe |
| D | 2'-OMe | 2'-OMe | 2'-F | 2'-OMe | 2'-F | 2'-OMe | 2'-OMe | 2'-OMe | 2'-OMe + PS | 2'-OMe + PS | 2'-OMe |
| E | 2'-OMe | 2'-OMe | 2'-F | 2'-OMe | 2'-F | 2'-OMe | 2'-OMe | 2'-OMe | 2'-OMe + PS | 2'-OMe + PS | 2'-OMe |
| F | 2'-OMe | 2'-OMe | 2'-F | 2'-OMe | 2'-F | 2'-OMe | 2'-OMe | 2'-OMe | 2'-OMe + PS | 2'-OMe + PS | 2'-OMe |

When the sense strand is 21 nucleotides in length, the sense strand is modified using one or a combination of two modification patterns as shown in Table 10-3:

TABLE 10-3

| Sense strand modification patterns Sense strand (SS) 5'-3' | | | | | | | | | | | |
|---|---|---|---|---|---|---|---|---|---|---|---|
| No. | 1 | 2 | 3 | 4 | 5 | 6 | 7 | 8 | 9 | 10 | 11 |
| a | 2'-OMe + PS | 2'-OMe + PS | 2'-OMe | 2'-OMe | 2'-OMe | 2'-OMe | 2'-F | 2'-OMe | 2'-F | 2'-F | 2'-F |
| b | 2'-OMe + PS | 2'-OMe + PS | 2'-OMe | 2'-OMe | 2'-OMe | 2'-OMe | 2'-F | 2'-OMe | 2'-F | 2'-OMe | 2'-F |

TABLE 10-3-continued

| Sense strand modification patterns Sense strand (SS) 5'-3' | | | | | | | | | | |
|---|---|---|---|---|---|---|---|---|---|---|
| No. | 12 | 13 | 14 | 15 | 16 | 17 | 18 | 19 | 20 | 21 |
| a | 2'-OMe | 2'-OMe | 2'-OMe | 2'-OMe | 2'-OMe | 2'-F | 2'-OMe | 2'-OMe | 2'-OMe | 2'-OMe |
| b | 2'-OMe | 2'-OMe | 2'-OMe | 2'-OMe | 2'-OMe | 2'-F | 2'-OMe | 2'-OMe | 2'-OMe | 2'-OMe |

When the sense strand is 20 nucleotides in length, the sense strand is modified using one or a combination of two modification patterns as shown in Table 10-4:

TABLE 10-4

| Sense strand modification patterns Sense strand (SS) 5'-3' | | | | | | | | | | |
|---|---|---|---|---|---|---|---|---|---|---|
| No. | 1 | 2 | 3 | 4 | 5 | 6 | 7 | 8 | 9 | 10 |
| a | 2'-OMe + PS | 2'-OMe + PS | 2'-OMe | 2'-OMe | 2'-OMe | 2'-F | 2'-OMe | 2'-F | 2'-F | 2'-F |
| b | 2'-OMe + PS | 2'-OMe + PS | 2'-OMe | 2'-OMe | 2'-OMe | 2'-F | 2'-OMe | 2'-F | 2'-OMe | 2'-F |
| No. | 11 | 12 | 13 | 14 | 15 | 16 | 17 | 18 | 19 | 20 |
| a | 2'-OMe | 2'-OMe | 2'-OMe | 2'-OMe | 2'-OMe | 2'-F | 2'-OMe | 2'-OMe | 2'-OMe | 2'-OMe |
| b | 2'-OMe | 2'-OMe | 2'-OMe | 2'-OMe | 2'-OMe | 2'-F | 2'-OMe | 2'-OMe | 2'-OMe | 2'-OMe |

In Tables 10-1 to 10-4, 2'-OMe represents 2'-methoxy; 2'-F represents 2'-fluoro; PS represents phosphorothioate backbone; EVP represents 5'-(E)-vinylphosphonate;

- the siRNA modification template with antisense strand modified by pattern A and sense strand modified by pattern a is designated as DV27P;
- the siRNA modification template with antisense strand modified by pattern A and sense strand modified by pattern b is designated as DV29P;
- the siRNA modification template with antisense strand modified by pattern B and sense strand modified by pattern a is designated as DV26P;
- the siRNA modification template with antisense strand modified by pattern B and sense strand modified by pattern b is designated as DV28P;
- the siRNA modification template with antisense strand modified by pattern C and sense strand modified by pattern b is designated as DV32P;
- the siRNA modification template with antisense strand modified by pattern D and sense strand modified by pattern b is designated as DV34P;
- the siRNA modification template with antisense strand modified by pattern E and sense strand modified by pattern a is designated as DV25P;
- the siRNA modification template with antisense strand modified by pattern F and sense strand modified by pattern b is designated as DV33P.

The synthesis methods for each sequence are the same as in Example 1.

TABLE 11

| Sequences modified with different modification templates | | | | | | | |
|---|---|---|---|---|---|---|---|
| Unmodified sequence code | Sequence code | Sense strand sequence 5'-3' | Sequence ID No | Unmodified sequence ID No | Antisense strand sequence 5'-3' | Sequence ID No | Unmodified sequence ID No |
| B207S | B207S-DV29P | Gms-Gms-Gm-Gm-Um-Uf-Um-Uf-Um-Cf-Um-Um-Gm-Um-Um-Gf-Am-Cm-Am-Am | 81 | 1 | UmsEVP-Ufs-Gm-Uf-Cf-Af-Am-Cm-Am-Am-Gm-Am-Am-Af-Am-Af-Cm-Cm-Cm-Cms-Gms-Cm | 179 | 8 |
| B207S | B27S-DV26P | Gms-Gms-Gm-Gm-Um-Uf-Um-Uf-Uf-Cf-Um-Um-Gm-Um-Um-Gf-Am-Cm-Am-Am | 82 | 1 | UmsEVP-Ufs-Gf-Uf-Cm-Af-Am-Cm-Am-Am-Gm-Am-Am-Af-Am-Af-Cm-Cm-Cm-Cms-Gms-Cm | 180 | 8 |
| B207S | B207S-DV27P | Gms-Gms-Gm-Gm-Um-Uf-Um-Uf-Uf-Cf-Um-Um-Gm-Um-Um-Gf-Am-Cm-Am-Am | 82 | 1 | UmsEVP-Ufs-Gm-Uf-Cf-Af-Am-Cm-Am-Am-Gm-Am-Am-Af-Am-Af-Cm-Cm-Cm-Cms-Gms-Cm | 179 | 8 |
| B207S | B207S-DV28P | Gms-Gms-Gm-Gm-Um-Uf-Um-Uf-Um-Cf-Um-Um-Gm-Um-Um-Gf-Am-Cm-Am-Am | 81 | 1 | UmsEVP-Ufs-Gf-Uf-Cm-Af-Am-Cm-Am-Am-Gm-Am-Am-Af-Am-Af-Cm-Cm-Cm-Cms-Gms-Cm | 180 | 8 |

TABLE 11-continued

| Sequences modified with different modification templates | | | | | | | |
|---|---|---|---|---|---|---|---|
| Unmodified sequence code | Sequence code | Sense strand sequence 5'-3' | Sequence ID No | Unmodified sequence ID No | Antisense strand sequence 5'-3' | Sequence ID No | Unmodified sequence ID No |
| B207S | B207S-DV32P | Gms-Gms-Gm-Gm-Um-Uf-Um-Uf-Um-Cf-Um-Um-Gm-Um-Um-Gf-Am-Cm-Am-Am | 81 | 1 | UmsEVP-Ufs-Gm-Um-Cf-Af-Am-Cm-Am-Am-Gm-Am-Am-Af-Am-Af-Cm-Cm-Cm-Cms-Gms-Cm | 181 | 8 |
| B207S | B207S-DV34P | Gms-Gms-Gm-Gm-Um-Uf-Um-Uf-Um-Cf-Um-Um-Gm-Um-Um-Gf-Am-Cm-Am-Am | 81 | 1 | UmsEVP-Ufs-Gf-Um-Cm-Af-Am-Cm-Am-Am-Gm-Am-Am-Af-Am-Af-Cm-Cm-Cm-Cms-Gms-Cm | 182 | 8 |
| B207S | B207S-DV25P | Gms-Gms-Gm-Gm-Um-Uf-Um-Uf-Uf-Cf-Um-Um-Gm-Um-Um-Gf-Am-Cm-Am-Am | 82 | 1 | UmsEVP-Ufs-Gm-Um-Cm-Af-Am-Cm-Am-Am-Gm-Am-Am-Af-Am-Af-Cm-Cm-Cm-Cms-Gms-Cm | 183 | 8 |
| B207S | B207S-DV33P | Gms-Gms-Gm-Gm-Um-Uf-Um-Uf-Um-Cf-Um-Um-Gm-Um-Um-Gf-Am-Cm-Am-Am | 81 | 1 | UmsEVP-Ufs-Gf-Um-Cf-Af-Am-Cm-Am-Am-Gm-Am-Am-Af-Am-Af-Cm-Cm-Cm-Cms-Gms-Cm | 184 | 8 |
| B207S | B20DV7S-30P | Gms-Gms-Gm-Gm-Um-Uf-Um-Uf-Uf-Cf-Um-Um-Gm-Um-Um-Gm-Am-Cm-Am-Am | 83 | 1 | UmsEVP-Ufs-Gm-Um-Cm-Af-Am-Cm-Am-Am-Gm-Am-Am-Af-Am-Am-Cm-Cm-Cm-Cms-Gms-Cm | 185 | 8 |
| B207S | B207S-DV31P | Gms-Gms-Gm-Gm-Um-Uf-Um-Uf-Uf-Cm-Um-Um-Gm-Um-Um-Gm-Am-Cm-Am-Am | 84 | 1 | UmsEVP-Ufs-Gm-Um-Cm-Af-Am-Cm-Am-Am-Gm-Am-Am-Af-Am-Af-Cm-Cm-Cm-Cms-Gms-Cm | 186 | 8 |
| B207S | B207S-DV21P | Gms-Gms-Gm-Gm-Um-Uf-Um-Uf-Uf-Cf-Um-Um-Gm-Um-Uf-Gf-Am-Cm-Am-Am | 85 | 1 | UmsEVP-Ufs-Gm-Um-Cm-Af-Am-Cm-Am-Am-Gm-Am-Am-Af-Am-Af-Cm-Cm-Cm-Cms-Gms-Cm | 186 | 8 |
| B207S | B207S-DV22P | Gms-Gms-Gm-Gm-Um-Uf-Um-Uf-Uf-Cf-Um-Um-Gm-Um-Um-Gm-Am-Cm-Am-Am | 83 | 1 | UmsEVP-Ufs-Gm-Um-Cm-Af-Am-Cm-Am-Am-Gm-Am-Am-Af-Am-Af-Cm-Cm-Cm-Cms-Gms-Cm | 186 | 8 |
| A1550 | A1550-DV29P | Cms-Cms-Cm-Gm-Um-Cm-Uf-Gm-Uf-Gm-Cf-Cm-Um-Um-Cm-Um-Cf-Am-Um-Cm-Um | 86 | 2 | AmsEVP-Gfs-Am-Uf-Gf-Af-Gm-Am-Am-Gm-Gm-Cm-Am-Cf-Am-Gf-Am-Cm-Gm-Gm-Gms-Gms-Am | 187 | 9 |
| A1550 | B1550-DV26P | Cms-Cms-Cm-Gm-Um-Cm-Uf-Gm-Uf-Gf-Cf-Cm-Um-Um-Cm-Um-Cf-Am-Um-Cm-Um | 87 | 2 | AmsEVP-Gfs-Af-Uf-Gm-Af-Gm-Am-Am-Gm-Gm-Cm-Am-Cf-Am-Gf-Am-Cm-Gm-Gm-Gms-Gms-Am | 188 | 9 |
| A1550 | B1550-DV27P | Cms-Cms-Cm-Gm-Um-Cm-Uf-Gm-Uf-Gf-Cf-Cm-Um-Um-Cm-Um-Cf-Am-Um-Cm-Um | 87 | 2 | AmsEVP-Gfs-Am-Uf-Gf-Af-Gm-Am-Am-Gm-Gm-Cm-Am-Cf-Am-Gf-Am-Cm-Gm-Gm-Gms-Gms-Am | 187 | 9 |
| A1550 | B1550-DV28P | Cms-Cms-Cm-Gm-Um-Cm-Uf-Gm-Uf-Gm-Cf-Cm-Um-Um-Cm-Um-Cf-Am-Um-Cm-Um | 86 | 2 | AmsEVP-Gfs-Af-Uf-Gm-Af-Gm-Am-Am-Gm-Gm-Cm-Am-Cf-Am-Gf-Am-Cm-Gm-Gm-Gms-Gms-Am | 188 | 9 |
| A1550 | B1550-DV32P | Cms-Cms-Cm-Gm-Um-Cm-Uf-Gm-Uf-Gm-Cf-Cm-Um-Um-Cm-Um-Cf-Am-Um-Cm-Um | 86 | 2 | AmsEVP-Gfs-Am-Um-Gf-Af-Gm-Am-Am-Gm-Gm-Cm-Am-Cf-Am-Gf-Am-Cm-Gm-Gm-Gms-Gms-Am | 189 | 9 |
| A1550 | B1550-DV34P | Cms-Cms-Cm-Gm-Um-Cm-Uf-Gm-Uf-Gm-Cf-Cm-Um-Um-Cm-Um-Cf-Am-Um-Cm-Um | 86 | 2 | AmsEVP-Gfs-Af-Um-Gm-Af-Gm-Am-Am-Gm-Gm-Cm-Am-Cf-Am-Gf-Am-Cm-Gm-Gm-Gms-Gms-Am | 190 | 9 |

TABLE 11-continued

Sequences modified with different modification templates

| Unmodified sequence code | Sequence code | Sense strand sequence 5'-3' | Sequence ID No | Unmodified sequence ID No | Antisense strand sequence 5'-3' | Sequence ID No | Unmodified sequence ID No |
|---|---|---|---|---|---|---|---|
| A1550 | B1550-DV25P | Cms-Cms-Cm-Gm-Um-Cm-Uf-Gm-Uf-Gf-Cf-Cm-Um-Um-Cm-Um-Cf-Am-Um-Cm-Um | 87 | 2 | AmsEVP-Gfs-Am-Um-Gm-Af-Gm-Am-Am-Gm-Gm-Cm-Am-Cf-Am-Gf-Am-Cm-Gm-Gm-Gms-Gms-Am | 191 | 9 |
| A1550 | B1550-DV33P | Cms-Cms-Cm-Gm-Um-Cm-Uf-Gm-Uf-Gm-Cf-Cm-Um-Um-Cm-Um-Cf-Am-Um-Cm-Um | 86 | 2 | AmsEVP-Gfs-Af-Um-Gf-Af-Gm-Am-Am-Gm-Gm-Cm-Am-Cf-Am-Gf-Am-Cm-Gm-Gm-Gms-Gms-Am | 192 | 9 |
| A1550 | B1550-DV30P | Cms-Cms-Cm-Gm-Um-Cm-Uf-Gm-Uf-Gf-Cf-Cm-Um-Um-Cm-Um-Cm-Am-Um-Cm-Um | 88 | 2 | AmsEVP-Gfs-Am-Um-Gm-Af-Gm-Am-Am-Gm-Gm-Cm-Am-Cf-Am-Gm-Am-Cm-Gm-Gm-Gms-Gms-Am | 193 | 9 |
| A1550 | B1550-DV31P | Cms-Cms-Cm-Gm-Um-Cm-Uf-Gm-Uf-Gf-Cm-Cm-Um-Um-Cm-Um-Cm-Am-Um-Cm-Um | 89 | 2 | AmsEVP-Gfs-Am-Um-Gm-Af-Gm-Am-Am-Gm-Gm-Cm-Am-Cf-Am-Gf-Am-Cm-Gm-Gm-Gms-Gms-Am | 194 | 9 |
| A1550 | B1550-DV21P | Cms-Cms-Cm-Gm-Um-Cm-Uf-Gm-Uf-Gf-Cf-Cm-Um-Um-Cm-Uf-Cf-Am-Um-Cm-Um | 90 | 2 | AmsEVP-Gfs-Am-Um-Gm-Af-Gm-Am-Am-Gm-Gm-Cm-Am-Cf-Am-Gf-Am-Cm-Gm-Gm-Gms-Gms-Am | 194 | 9 |
| A1550 | B1550-DV22P | Cms-Cms-Cm-Gm-Um-Cm-Uf-Gm-Uf-Gf-Cf-Cm-Um-Um-Cm-Um-Cm-Am-Um-Cm-Um | 88 | 2 | AmsEVP-Gfs-Am-Um-Gm-Af-Gm-Am-Am-Gm-Gm-Cm-Am-Cf-Am-Gf-Am-Cm-Gm-Gm-Gms-Gms-Am | 194 | 9 |
| B1572 | B1572-DV29P | Cms-Cms-Gm-Gm-Am-Cm-Cf-Gm-Uf-Gm-Uf-Gm-Cm-Am-Cm-Um-Uf-Cm-Gm-Cm-Um | 91 | 3 | AmsEVP-Gfs-Cm-Gf-Af-Af-Gm-Um-Gm-Cm-Am-Cm-Am-Cf-Gm-Gf-Um-Cm-Cm-Gm-Gms-Cms-Am | 195 | 10 |
| B1572 | B1572-DV26P | Cms-Cms-Gm-Gm-Am-Cm-Cf-Gm-Uf-Gf-Uf-Gm-Cm-Am-Cm-Um-Uf-Cm-Gm-Cm-Um | 92 | 3 | AmsEVP-Gfs-Cf-Gf-Am-Af-Gm-Um-Gm-Cm-Am-Cm-Am-Cf-Gm-Gf-Um-Cm-Cm-Gm-Gms-Cms-Am | 196 | 10 |
| B1572 | B1572-DV27P | Cms-Cms-Gm-Gm-Am-Cm-Cf-Gm-Uf-Gf-Uf-Gm-Cm-Am-Cm-Um-Uf-Cm-Gm-Cm-Um | 92 | 3 | AmsEVP-Gfs-Cm-Gf-Af-Af-Gm-Um-Gm-Cm-Am-Cm-Am-Cf-Gm-Gf-Um-Cm-Cm-Gm-Gms-Cms-Am | 195 | 10 |
| B1572 | B1572-DV28P | Cms-Cms-Gm-Gm-Am-Cm-Cf-Gm-Uf-Gm-Uf-Gm-Cm-Am-Cm-Um-Uf-Cm-Gm-Cm-Um | 91 | 3 | AmsEVP-Gfs-Cf-Gf-Am-Af-Gm-Um-Gm-Cm-Am-Cm-Am-Cf-Gm-Gf-Um-Cm-Cm-Gm-Gms-Cms-Am | 196 | 10 |
| B1572 | B1572-DV32P | Cms-Cms-Gm-Gm-Am-Cm-Cf-Gm-Uf-Gm-Uf-Gm-Cm-Am-Cm-Um-Uf-Cm-Gm-Cm-Um | 91 | 3 | AmsEVP-Gfs-Cm-Gm-Af-Af-Gm-Um-Gm-Cm-Am-Cm-Am-Cf-Gm-Gf-Um-Cm-Cm-Gm-Gms-Cms-Am | 197 | 10 |
| B1572 | B1572-DV34P | Cms-Cms-Gm-Gm-Am-Cm-Cf-Gm-Uf-Gm-Uf-Gm-Cm-Am-Cm-Um-Uf-Cm-Gm-Cm-Um | 91 | 3 | AmsEVP-Gfs-Cf-Gm-Am-Af-Gm-Um-Gm-Cm-Am-Cm-Am-Cf-Gm-Gf-Um-Cm-Cm-Gm-Gms-Cms-Am | 198 | 10 |
| B1572 | B1572-DV30P | Cms-Cms-Gm-Gm-Am-Cm-Cf-Gm-Uf-Gf-Uf-Gm-Cm-Am-Cm-Um-Um-Cm-Gm-Cm-Um | 93 | 3 | AmsEVP-Gfs-Cm-Gm-Am-Af-Gm-Um-Gm-Cm-Am-Cm-Am-Cf-Gm-Gm-Um-Cm-Cm-Gm-Gms-Cms-Am | 199 | 10 |
| B1572 | B1572-DV31P | Cms-Cms-Gm-Gm-Am-Cm-Cf-Gm-Uf-Gf-Um-Gm-Cm-Am-Cm-Um-Um-Cm-Gm-Cm-Um | 94 | 3 | AmsEVP-Gfs-Cm-Gm-Am-Af-Gm-Um-Gm-Cm-Am-Cm-Am-Cf-Gm-Gf-Um-Cm-Cm-Gm-Gms-Cms-Am | 200 | 10 |

TABLE 11-continued

| Sequences modified with different modification templates | | | | | | | |
|---|---|---|---|---|---|---|---|
| Unmodified sequence code | Sequence code | Sense strand sequence 5'-3' | Sequence ID No | Unmodified sequence ID No | Antisense strand sequence 5'-3' | Sequence ID No | Unmodified sequence ID No |
| B1572 | B1572-DV21P | Cms-Cms-Gm-Gm-Am-Cm-Cf-Gm-Uf-Gf-Uf-Gm-Cm-Am-Cm-Uf-Uf-Cm-Gm-Cm-Um | 95 | 3 | AmsEVP-Gfs-Cm-Gm-Am-Af-Gm-Um-Gm-Cm-Am-Cm-Am-Cf-Gm-Gf-Um-Cm-Cm-Gm-Gms-Cms-Am | 200 | 10 |
| B1572 | B1572-DV22P | Cms-Cms-Gm-Gm-Am-Cm-Cf-Gm-Uf-Gf-Uf-Gm-Cm-Am-Cm-Um-Um-Cm-Gm-Cm-Um | 93 | 3 | AmsEVP-Gfs-Cm-Gm-Am-Af-Gm-Um-Gm-Cm-Am-Cm-Am-Cf-Gm-Gf-Um-Cm-Cm-Gm-Gms-Cms-Am | 200 | 10 |
| B1575 | B1575-DV29P | Gms-Ams-Cm-Cm-Gm-Um-Gf-Um-Gf-Cm-Af-Cm-Um-Um-Cm-Gm-Cf-Um-Um-Cm-Am | 96 | 4 | UmsEVP-Gfs-Am-Af-Gf-Cf-Gm-Am-Am-Gm-Um-Gm-Cm-Af-Cm-Af-Cm-Gm-Gm-Um-Cms-Cms-Gm | 201 | 11 |
| B1575 | B1575-DV26P | Gms-Ams-Cm-Cm-Gm-Um-Gf-Um-Gf-Cf-Af-Cm-Um-Um-Cm-Gm-Cf-Um-Um-Cm-Am | 97 | 4 | UmsEVP-Gfs-Af-Af-Gm-Cf-Gm-Am-Am-Gm-Um-Gm-Cm-Af-Cm-Af-Cm-Gm-Gm-Um-Cms-Cms-Gm | 202 | 11 |
| B1575 | B1575-DV27P | Gms-Ams-Cm-Cm-Gm-Um-Gf-Um-Gf-Cf-Af-Cm-Um-Um-Cm-Gm-Cf-Um-Um-Cm-Am | 97 | 4 | UmsEVP-Gfs-Am-Af-Gf-Cf-Gm-Am-Am-Gm-Um-Gm-Cm-Af-Cm-Af-Cm-Gm-Gm-Um-Cms-Cms-Gm | 201 | 11 |
| B1575 | B1575-DV28P | Gms-Ams-Cm-Cm-Gm-Um-Gf-Um-Gf-Cm-Af-Cm-Um-Um-Cm-Gm-Cf-Um-Um-Cm-Am | 96 | 4 | UmsEVP-Gfs-Af-Af-Gm-Cf-Gm-Am-Am-Gm-Um-Gm-Cm-Af-Cm-Af-Cm-Gm-Gm-Um-Cms-Cms-Gm | 202 | 11 |
| B1575 | B1575-DV32P | Gms-Ams-Cm-Cm-Gm-Um-Gf-Um-Gf-Cm-Af-Cm-Um-Um-Cm-Gm-Cf-Um-Um-Cm-Am | 96 | 4 | UmsEVP-Gfs-Am-Am-Gf-Cf-Gm-Am-Am-Gm-Um-Gm-Cm-Af-Cm-Af-Cm-Gm-Gm-Um-Cms-Cms-Gm | 203 | 11 |
| B1575 | B1575-DV34P | Gms-Ams-Cm-Cm-Gm-Um-Gf-Um-Gf-Cm-Af-Cm-Um-Um-Cm-Gm-Cf-Um-Um-Cm-Am | 96 | 4 | UmsEVP-Gfs-Af-Am-Gm-Cf-Gm-Am-Am-Gm-Um-Gm-Cm-Af-Cm-Af-Cm-Gm-Gm-Um-Cms-Cms-Gm | 204 | 11 |
| B1575 | B1575-DV30P | Gms-Ams-Cm-Cm-Gm-Um-Gf-Um-Gf-Cf-Af-Cm-Um-Um-Cm-Gm-Cm-Um-Um-Cm-Am | 98 | 4 | UmsEVP-Gfs-Am-Am-Gm-Cf-Gm-Am-Am-Gm-Um-Gm-Cm-Af-Cm-Am-Cm-Gm-Gm-Um-Cms-Cms-Gm | 205 | 11 |
| B1575 | B1575-DV31P | Gms-Ams-Cm-Cm-Gm-Um-Gf-Um-Gf-Cf-Am-Cm-Um-Um-Cm-Gm-Cm-Um-Um-Cm-Am | 99 | 4 | UmsEVP-Gfs-Am-Am-Gm-Cf-Gm-Am-Am-Gm-Um-Gm-Cm-Af-Cm-Af-Cm-Gm-Gm-Um-Cms-Cms-Gm | 206 | 11 |
| B1575 | B1575-DV21P | Gms-Ams-Cm-Cm-Gm-Um-Gf-Um-Gf-Cf-Af-Cm-Um-Um-Cm-Gf-Cf-Um-Um-Cm-Am | 100 | 4 | UmsEVP-Gfs-Am-Am-Gm-Cf-Gm-Am-Am-Gm-Um-Gm-Cm-Af-Cm-Af-Cm-Gm-Gm-Um-Cms-Cms-Gm | 206 | 11 |
| B1575 | B1575-DV22F | Gms-Ams-Cm-Cm-Gm-Um-Gf-Um-Gf-Cf-Af-Cm-Um-Um-Cm-Gm-Cm-Um-Um-Cm-Am | 98 | 4 | UmsEVP-Gfs-Am-Am-Gm-Cf-Gm-Am-Am-Gm-Um-Gm-Cm-Af-Cm-Af-Cm-Gm-Gm-Um-Cms-Cms-Gm | 206 | 11 |
| A1573 | A1573-DV29P | Cms-Gms-Gm-Am-Cm-Cm-Gf-Um-Gf-Um-Gf-Cm-Am-Cm-Um-Um-Cf-Gm-Cm-Um-Um | 101 | 5 | AmsEVP-Afs-Gm-Cf-Gf-Af-Am-Gm-Um-Gm-Cm-Am-Cm-Af-Cm-Gf-Gm-Um-Cm-Cm-Gms-Gms-Cm | 207 | 12 |
| A1573 | B1573-DV26P | Cms-Gms-Gm-Am-Cm-Cm-Gf-Um-Gf-Uf-Gf-Cm-Am-Cm-Um-Um-Cf-Gm-Cm-Um-Um | 102 | 5 | AmsEVP-Afs-Gf-Cf-Gm-Af-Am-Gm-Um-Gm-Cm-Am-Cm-Af-Cm-Gf-Gm-Um-Cm-Cm-Gms-Gms-Cm | 208 | 12 |

TABLE 11-continued

Sequences modified with different modification templates

| Unmodified sequence code | Sequence code | Sense strand sequence 5'-3' | Sequence ID No | Unmodified sequence ID No | Antisense strand sequence 5'-3' | Sequence ID No | Unmodified sequence ID No |
|---|---|---|---|---|---|---|---|
| A1573 | B1573-DV27P | Cms-Gms-Gm-Am-Cm-Cm-Gf-Um-Gf-Uf-Gf-Cm-Am-Cm-Um-Um-Cf-Gm-Cm-Um-Um | 102 | 5 | AmsEVP-Afs-Gm-Cf-Gf-Af-Am-Gm-Um-Gm-Cm-Am-Cm-Af-Cm-Gf-Gm-Um-Cm-Cm-Gms-Gms-Cm | 207 | 12 |
| A1573 | B1573-DV28P | Cms-Gms-Gm-Am-Cm-Cm-Gf-Um-Gf-Um-Gf-Cm-Am-Cm-Um-Um-Cf-Gm-Cm-Um-Um | 101 | 5 | AmsEVP-Afs-Gf-Cf-Gm-Af-Am-Gm-Um-Gm-Cm-Am-Cm-Af-Cm-Gf-Gm-Um-Cm-Cm-Gms-Gms-Cm | 208 | 12 |
| A1573 | B1573-DV32P | Cms-Gms-Gm-Am-Cm-Cm-Gf-Um-Gf-Um-Gf-Cm-Am-Cm-Um-Um-Cf-Gm-Cm-Um-Um | 101 | 5 | AmsEVP-Afs-Gm-Cm-Gf-Af-Am-Gm-Um-Gm-Cm-Am-Cm-Af-Cm-Gf-Gm-Um-Cm-Cm-Gms-Gms-Cm | 209 | 12 |
| A1573 | B1573-DV34P | Cms-Gms-Gm-Am-Cm-Cm-Gf-Um-Gf-Um-Gf-Cm-Am-Cm-Um-Um-Cf-Gm-Cm-Um-Um | 101 | 5 | AmsEVP-Afs-Gf-Cm-Gm-Af-Am-Gm-Um-Gm-Cm-Am-Cm-Af-Cm-Gf-Gm-Um-Cm-Cm-Gms-Gms-Cm | 210 | 12 |
| A1573 | B1573-DV30P | Cms-Gms-Gm-Am-Cm-Cm-Gf-Um-Gf-Uf-Gf-Cm-Am-Cm-Um-Um-Cm-Gm-Cm-Um-Um | 103 | 5 | AmsEVP-Afs-Gm-Cm-Gm-Af-Am-Gm-Um-Gm-Cm-Am-Cm-Af-Cm-Gm-Gm-Um-Cm-Cm-Gms-Gms-Cm | 211 | 12 |
| A1573 | B1573-DV31P | Cms-Gms-Gm-Am-Cm-Cm-Gf-Um-Gf-Uf-Gm-Cm-Am-Cm-Um-Um-Cm-Gm-Cm-Um-Um | 104 | 5 | AmsEVP-Afs-Gm-Cm-Gm-Af-Am-Gm-Um-Gm-Cm-Am-Cm-Af-Cm-Gf-Gm-Um-Cm-Cm-Gms-Gms-Cm | 212 | 12 |
| A1573 | B1573-DV21P | Cms-Gms-Gm-Am-Cm-Cm-Gf-Um-Gf-Uf-Gf-Cm-Am-Cm-Um-Uf-Cf-Gm-Cm-Um-Um | 105 | 5 | AmsEVP-Afs-Gm-Cm-Gm-Af-Am-Gm-Um-Gm-Cm-Am-Cm-Af-Cm-Gf-Gm-Um-Cm-Cm-Gms-Gms-Cm | 212 | 12 |
| A1573 | B1573-DV22P | Cms-Gms-Gm-Am-Cm-Cm-Gf-Um-Gf-Uf-Gf-Cm-Am-Cm-Um-Um-Cm-Gm-Cm-Um-Um | 103 | 5 | AmsEVP-Afs-Gm-Cm-Gm-Af-Am-Gm-Um-Gm-Cm-Am-Cm-Af-Cm-Gf-Gm-Um-Cm-Cm-Gms-Gms-Cm | 212 | 12 |
| B418S | B418S-DV29P | Cms-Ums-Gm-Cm-Um-Af-Um-Gf-Cm-Cf-Um-Cm-Am-Um-Cm-Uf-Um-Cm-Um-Um | 106 | 6 | AmsEVP-Afs-Gm-Af-Af-Gf-Am-Um-Gm-Am-Gm-Gm-Cm-Af-Um-Af-Gm-Cm-Am-Gms-Cms-Am | 213 | 13 |
| B418S | B418S-DV26P | Cms-Ums-Gm-Cm-Um-Af-Um-Gf-Cf-Cf-Um-Cm-Am-Um-Cm-Uf-Um-Cm-Um-Um | 107 | 6 | AmsEVP-Afs-Gf-Af-Am-Gf-Am-Um-Gm-Am-Gm-Gm-Cm-Af-Um-Af-Gm-Cm-Am-Gms-Cms-Am | 214 | 13 |
| B418S | B418S-DV27P | Cms-Ums-Gm-Cm-Um-Af-Um-Gf-Cf-Cf-Um-Cm-Am-Um-Cm-Uf-Um-Cm-Um-Um | 107 | 6 | AmsEVP-Afs-Gm-Af-Af-Gf-Am-Um-Gm-Am-Gm-Gm-Cm-Af-Um-Af-Gm-Cm-Am-Gms-Cms-Am | 213 | 13 |
| B418S | B418S-DV28P | Cms-Ums-Gm-Cm-Um-Af-Um-Gf-Cm-Cf-Um-Cm-Am-Um-Cm-Uf-Um-Cm-Um-Um | 106 | 6 | AmsEVP-Afs-Gf-Af-Am-Gf-Am-Um-Gm-Am-Gm-Gm-Cm-Af-Um-Af-Gm-Cm-Am-Gms-Cms-Am | 214 | 13 |
| B418S | B418S-DV32P | Cms-Ums-Gm-Cm-Um-Af-Um-Gf-Cm-Cf-Um-Cm-Am-Um-Cm-Uf-Um-Cm-Um-Um | 106 | 6 | AmsEVP-Afs-Gm-Am-Af-Gf-Am-Um-Gm-Am-Gm-Gm-Cm-Af-Um-Af-Gm-Cm-Am-Gms-Cms-Am | 215 | 13 |

TABLE 11-continued

| Sequences modified with different modification templates | | | | | | | |
|---|---|---|---|---|---|---|---|
| Unmodified sequence code | Sequence code | Sense strand sequence 5'-3' | Sequence ID No | Unmodified sequence ID No | Antisense strand sequence 5'-3' | Sequence ID No | Unmodified sequence ID No |
| B418S | B418S-DV34P | Cms-Ums-Gm-Cm-Um-Af-Um-Gf-Cm-Cf-Um-Cm-Am-Um-Cm-Uf-Um-Cm-Um-Um | 106 | 6 | AmsEVP-Afs-Gf-Am-Am-Gf-Am-Um-Gm-Am-Gm-Gm-Cm-Af-Um-Af-Gm-Cm-Am-Gms-Cms-Am | 216 | 13 |
| B418S | B418S-DV30P | Cms-Ums-Gm-Cm-Um-Af-Um-Gf-Cf-Cf-Um-Cm-Am-Um-Cm-Um-Um-Cm-Um-Um | 108 | 6 | AmsEVP-Afs-Gm-Am-Am-Gf-Am-Um-Gm-Am-Gm-Gm-Cm-Af-Um-Am-Gm-Cm-Am-Gms-Cms-Am | 217 | 13 |
| B418S | B418S-DV31P | Cms-Ums-Gm-Cm-Um-Af-Um-Gf-Cf-Cm-Um-Cm-Am-Um-Cm-Um-Um-Cm-Um-Um | 109 | 6 | AmsEVP-Afs-Gm-Am-Am-Gf-Am-Um-Gm-Am-Gm-Gm-Cm-Af-Um-Af-Gm-Cm-Am-Gms-Cms-Am | 218 | 13 |
| B418S | B418S-DV21P | Cms-Ums-Gm-Cm-Um-Af-Um-Gf-Cf-Cf-Um-Cm-Am-Um-Cf-Uf-Um-Cm-Um-Um | 110 | 6 | AmsEVP-Afs-Gm-Am-Am-Gf-Am-Um-Gm-Am-Gm-Gm-Cm-Af-Um-Af-Gm-Cm-Am-Gms-Cms-Am | 218 | 13 |
| B418S | B418S-DV22P | Cms-Ums-Gm-Cm-Um-Af-Um-Gf-Cf-Cf-Um-Cm-Am-Um-Cm-Um-Um-Cm-Um-Um | 108 | 6 | AmsEVP-Afs-Gm-Am-Am-Gf-Am-Um-Gm-Am-Gm-Gm-Cm-Af-Um-Af-Gm-Cm-Am-Gms-Cms-Am | 218 | 13 |
| A416 | A416-DV29P | Ums-Gms-Cm-Um-Gm-Cm-Uf-Am-Uf-Gm-Cf-Cm-Um-Cm-Am-Um-Cf-Um-Um-Cm-Um | 111 | 7 | AmsEVP-Gfs-Am-Af-Gf-Af-Um-Gm-Am-Gm-Gm-Cm-Am-Uf-Am-Gf-Cm-Am-Gm-Cm-Ams-Gms-Gm | 219 | 14 |
| A416 | B416-DV26P | Ums-Gms-Cm-Um-Gm-Cm-Uf-Am-Uf-Gf-Cf-Cm-Um-Cm-Am-Um-Cf-Um-Um-Cm-Um | 112 | 7 | AmsEVP-Gfs-Af-Af-Gm-Af-Um-Gm-Am-Gm-Gm-Cm-Am-Uf-Am-Gf-Cm-Am-Gm-Cm-Ams-Gms-Gm | 220 | 14 |
| A416 | B416-DV27P | Ums-Gms-Cm-Um-Gm-Cm-Uf-Am-Uf-Gf-Cf-Cm-Um-Cm-Am-Um-Cf-Um-Um-Cm-Um | 112 | 7 | AmsEVP-Gfs-Am-Af-Gf-Af-Um-Gm-Am-Gm-Gm-Cm-Am-Uf-Am-Gf-Cm-Am-Gm-Cm-Ams-Gms-Gm | 219 | 14 |
| A416 | B416-DV28P | Ums-Gms-Cm-Um-Gm-Cm-Uf-Am-Uf-Gm-Cf-Cm-Um-Cm-Am-Um-Cf-Um-Um-Cm-Um | 111 | 7 | AmsEVP-Gfs-Af-Af-Gm-Af-Um-Gm-Am-Gm-Gm-Cm-Am-Uf-Am-Gf-Cm-Am-Gm-Cm-Ams-Gms-Gm | 220 | 14 |
| A416 | B416-DV32P | Ums-Gms-Cm-Um-Gm-Cm-Uf-Am-Uf-Gm-Cf-Cm-Um-Cm-Am-Um-Cf-Um-Um-Cm-Um | 111 | 7 | AmsEVP-Gfs-Am-Am-Gf-Af-Um-Gm-Am-Gm-Gm-Cm-Am-Uf-Am-Gf-Cm-Am-Gm-Cm-Ams-Gms-Gm | 221 | 14 |
| A416 | B416-DV34P | Ums-Gms-Cm-Um-Gm-Cm-Uf-Am-Uf-Gm-Cf-Cm-Um-Cm-Am-Um-Cf-Um-Um-Cm-Um | 111 | 7 | AmsEVP-Gfs-Af-Am-Gm-Af-Um-Gm-Am-Gm-Gm-Cm-Am-Uf-Am-Gf-Cm-Am-Gm-Cm-Ams-Gms-Gm | 222 | 14 |
| A416 | B416-DV30P | Ums-Gms-Cm-Um-Gm-Cm-Uf-Am-Uf-Gf-Cf-Cm-Um-Cm-Am-Um-Cm-Um-Um-Cm-Um | 113 | 7 | AmsEVP-Gfs-Am-Am-Gm-Af-Um-Gm-Am-Gm-Gm-Cm-Am-Uf-Am-Gm-Cm-Am-Gm-Cm-Ams-Gms-Gm | 223 | 14 |
| A416 | B416-DV31P | Ums-Gms-Cm-Um-Gm-Cm-Uf-Am-Uf-Gf-Cm-Cm-Um-Cm-Am-Um-Cm-Um-Um-Cm-Um | 114 | 7 | AmsEVP-Gfs-Am-Am-Gm-Af-Um-Gm-Am-Gm-Gm-Cm-Am-Uf-Am-Gm-Cf-Am-Gm-Cm-Ams-Gms-Gm | 224 | 14 |
| A416 | B416-DV21P | Ums-Gms-Cm-Um-Gm-Cm-Uf-Am-Uf-Gf-Cf-Cm-Um-Cm-Am-Uf-Cf-Um-Um-Cm-Um | 115 | 7 | AmsEVP-Gfs-Am-Am-Gm-Af-Um-Gm-Am-Gm-Gm-Cm-Am-Uf-Am-Gm-Cf-Am-Gm-Cm-Ams-Gms-Gm | 224 | 14 |

TABLE 11-continued

Sequences modified with different modification templates

| Unmodified sequence code | Sequence code | Sense strand sequence 5'-3' | Sequence ID No | Unmodified sequence ID No | Antisense strand sequence 5'-3' | Sequence ID No | Unmodified sequence ID No |
|---|---|---|---|---|---|---|---|
| A416 | B416-DV22P | Ums-Gms-Cm-Um-Gm-Cm-Uf-Am-Uf-Gf-Cf-Cm-Um-Cm-Am-Um-Cm-Um-Um-Cm-Um | 113 | 7 | AmsEVP-Gfs-Am-Am-Gm-Af-Um-Gm-Am-Gm-Gm-Cm-Am-Uf-Am-Gm-Cf-Am-Gm-Cm-Ams-Gms-Gm | 224 | 14 |
| A205 | A205-DV29F | Gms-Cms-Gm-Gm-Gm-Gm-Uf-Um-Uf-Um-Uf-Cm-Um-Um-Gm-Um-Uf-Gm-Am-Cm-Am | 116 | 18 | UmsEVP-Gfs-Um-Cf-Af-Af-Cm-Am-Am-Gm-Am-Am-Am-Af-Am-Cf-Cm-Cm-Cm-Gm-Cms-Cms-Um | 225 | 50 |
| A205 | B205-DV26P | Gms-Cms-Gm-Gm-Gm-Gm-Uf-Um-Uf-Uf-Uf-Cm-Um-Um-Gm-Um-Uf-Gm-Am-Cm-Am | 117 | 18 | UmsEVP-Gfs-Uf-Cf-Am-Af-Cm-Am-Am-Gm-Am-Am-Am-Af-Am-Cf-Cm-Cm-Cm-Gm-Cms-Cms-Um | 226 | 50 |
| A205 | B205-DV27P | Gms-Cms-Gm-Gm-Gm-Gm-Uf-Um-Uf-Uf-Uf-Cm-Um-Um-Gm-Um-Uf-Gm-Am-Cm-Am | 117 | 18 | UmsEVP-Gfs-Um-Cf-Af-Af-Cm-Am-Am-Gm-Am-Am-Am-Af-Am-Cf-Cm-Cm-Cm-Gm-Cms-Cms-Um | 225 | 50 |
| A205 | B205-DV28P | Gms-Cms-Gm-Gm-Gm-Gm-Uf-Um-Uf-Um-Uf-Cm-Um-Um-Gm-Um-Uf-Gm-Am-Cm-Am | 116 | 18 | UmsEVP-Gfs-Uf-Cf-Am-Af-Cm-Am-Am-Gm-Am-Am-Am-Af-Am-Cf-Cm-Cm-Cm-Gm-Cms-Cms-Um | 226 | 50 |
| A205 | B205-DV32P | Gms-Cms-Gm-Gm-Gm-Gm-Uf-Um-Uf-Um-Uf-Cm-Um-Um-Gm-Um-Uf-Gm-Am-Cm-Am | 116 | 18 | UmsEVP-Gfs-Um-Cm-Af-Af-Cm-Am-Am-Gm-Am-Am-Am-Af-Am-Cf-Cm-Cm-Cm-Gm-Cms-Cms-Um | 227 | 50 |
| A205 | B205-DV34P | Gms-Cms-Gm-Gm-Gm-Gm-Uf-Um-Uf-Um-Uf-Cm-Um-Um-Gm-Um-Uf-Gm-Am-Cm-Am | 116 | 18 | UmsEVP-Gfs-Uf-Cm-Am-Af-Cm-Am-Am-Gm-Am-Am-Am-Af-Am-Cf-Cm-Cm-Cm-Gm-Cms-Cms-Um | 228 | 50 |
| A205 | B205-DV30P | Gms-Cms-Gm-Gm-Gm-Gm-Uf-Um-Uf-Uf-Uf-Cm-Um-Um-Gm-Um-Um-Gm-Am-Cm-Am | 118 | 18 | UmsEVP-Gfs-Um-Cm-Am-Af-Cm-Am-Am-Gm-Am-Am-Am-Af-Am-Cm-Cm-Cm-Cm-Gm-Cms-Cms-Um | 229 | 50 |
| A205 | B205-DV31P | Gms-Cms-Gm-Gm-Gm-Gm-Uf-Um-Uf-Uf-Um-Cm-Um-Um-Gm-Um-Um-Gm-Am-Cm-Am | 119 | 18 | UmsEVP-Gfs-Um-Cm-Am-Af-Cm-Am-Am-Gm-Am-Am-Am-Af-Am-Cf-Cm-Cm-Cm-Gm-Cms-Cms-Um | 230 | 50 |
| A205 | B205-DV21P | Gms-Cms-Gm-Gm-Gm-Gm-Uf-Um-Uf-Uf-Uf-Cm-Um-Um-Gm-Uf-Uf-Gm-Am-Cm-Am | 120 | 18 | UmsEVP-Gfs-Um-Cm-Am-Af-Cm-Am-Am-Gm-Am-Am-Am-Af-Am-Cf-Cm-Cm-Cm-Gm-Cms-Cms-Um | 230 | 50 |
| A205 | B205-DV22P | Gms-Cms-Gm-Gm-Gm-Gm-Uf-Um-Uf-Uf-Uf-Cm-Um-Um-Gm-Um-Um-Gm-Am-Cm-Am | 118 | 18 | UmsEVP-Gfs-Um-Cm-Am-Af-Cm-Am-Am-Gm-Am-Am-Am-Af-Am-Cf-Cm-Cm-Cm-Gm-Cms-Cms-Um | 230 | 50 |
| A261 | A21-DV29P | Gms-Ums-Gm-Gm-Am-Cm-Uf-Um-Cf-Um-Cf-Um-Cm-Am-Am-Um-Uf-Um-Um-Cm-Um | 126 | 25 | AmsEVP-Gfs-Am-Af-Af-Af-Um-Um-Gm-Am-Gm-Am-Gm-Af-Am-Gf-Um-Cm-Cm-Am-Cms-Cms-Am | 237 | 57 |
| A261 | B261-DV26P | Gms-Ums-Gm-Gm-Am-Cm-Uf-Um-Cf-Uf-Cf-Um-Cm-Am-Am-Um-Uf-Um-Um-Cm-Um | 127 | 25 | AmsEVP-Gfs-Af-Af-Am-Af-Um-Um-Gm-Am-Gm-Am-Gm-Af-Am-Gf-Um-Cm-Cm-Am-Cms-Cms-Am | 238 | 57 |
| A261 | B261-DV271 | Gms-Ums-Gm-Gm-Am-Cm-Uf-Um-Cf-Uf-Cf-Um-Cm-Am-Am-Um-Uf-Um-Um-Cm-Um | 127 | 25 | AmsEVP-Gfs-Am-Af-Af-Af-Um-Um-Gm-Am-Gm-Am-Gm-Af-Am-Gf-Um-Cm-Cm-Am-Cms-Cms-Am | 237 | 57 |
| A261 | B261- | Gms-Ums-Gm-Gm-Am-Cm-Uf-Um-Cf-Um-Cf- | 126 | 25 | AmsEVP-Gfs-Af-Af-Am-Af-Um-Um-Gm-Am-Gm-Am-Gm- | 238 | 57 |

TABLE 11-continued

Sequences modified with different modification templates

| Unmodified sequence code | Sequence code | Sense strand sequence 5'-3' | Sequence ID No | Unmodified sequence ID No | Antisense strand sequence 5'-3' | Sequence ID No | Unmodified sequence ID No |
|---|---|---|---|---|---|---|---|
| | DV 28P | Um-Cm-Am-Am-Um-Uf-Um-Um-Cm-Um | | | Af-Am-Gf-Um-Cm-Cm-Am-Cms-Cms-Am | | |
| A261 | B261-DV32P | Gms-Ums-Gm-Gm-Am-Cm-Uf-Um-Cf-Um-Cf-Um-Cm-Am-Am-Um-Uf-Um-Um-Cm-Um | 126 | 25 | AmsEVP-Gfs-Am-Am-Af-Af-Um-Um-Gm-Am-Gm-Am-Gm-Af-Am-Gf-Um-Cm-Cm-Am-Cms-Cms-Am | 239 | 57 |
| A261 | B261-DV34P | Gms-Ums-Gm-Gm-Am-Cm-Uf-Um-Cf-Um-Cf-Um-Cm-Am-Am-Um-Uf-Um-Um-Cm-Um | 126 | 25 | AmsEVP-Gfs-Af-Am-Am-Af-Um-Um-Gm-Am-Gm-Am-Gm-Af-Am-Gf-Um-Cm-Cm-Am-Cms-Cms-Am | 240 | 57 |
| A261 | B261-DV30P | Gms-Ums-Gm-Gm-Am-Cm-Uf-Um-Cf-Uf-Cf-Um-Cm-Am-Am-Um-Um-Um-Um-Cm-Um | 128 | 25 | AmsEVP-Gfs-Am-Am-Am-Af-Um-Um-Gm-Am-Gm-Am-Gm-Af-Am-Gm-Um-Cm-Cm-Am-Cms-Cms-Am | 241 | 57 |
| A261 | B261-DV31P | Gms-Ums-Gm-Gm-Am-Cm-Uf-Um-Cf-Uf-Cm-Um-Cm-Am-Am-Um-Um-Um-Um-Cm-Um | 129 | 25 | AmsEVP-Gfs-Am-Am-Am-Af-Um-Um-Gm-Am-Gm-Am-Gm-Af-Am-Gf-Um-Cm-Cm-Am-Cms-Cms-Am | 242 | 57 |
| A261 | B261-DV21P | Gms-Ums-Gm-Gm-Am-Cm-Uf-Um-Cf-Uf-Cf-Um-Cm-Am-Am-Uf-Uf-Um-Um-Cm-Um | 130 | 25 | AmsEVP-Gfs-Am-Am-Am-Af-Um-Um-Gm-Am-Gm-Am-Gm-Af-Am-Gf-Um-Cm-Cm-Am-Cms-Cms-Am | 242 | 57 |
| A261 | B261-DV22P | Gms-Ums-Gm-Gm-Am-Cm-Uf-Um-Cf-Uf-Cf-Um-Cm-Am-Am-Um-Um-Um-Um-Cm-Um | 128 | 25 | AmsEVP-Gfs-Am-Am-Am-Af-Um-Um-Gm-Am-Gm-Am-Gm-Af-Am-Gf-Um-Cm-Cm-Am-Cms-Cms-Am | 242 | 57 |
| B208 | B208-DV29P | Gms-Gms-Gm-Um-Um-Um-Uf-Um-Cf-Um-Uf-Gm-Um-Um-Gm-Am-Cf-Am-Am-Gm-Am | 121 | 38 | UmsEVP-Cfs-Um-Uf-Gf-Uf-Cm-Am-Am-Cm-Am-Am-Gm-Af-Am-Af-Am-Am-Cm-Cm-Cms-Cms-Gm | 231 | 70 |
| B208 | B208-DV26P | Gms-Gms-Gm-Um-Um-Um-Uf-Um-Cf-Uf-Uf-Gm-Um-Um-Gm-Am-Cf-Am-Am-Gm-Am | 122 | 38 | UmsEVP-Cfs-Uf-Uf-Gm-Uf-Cm-Am-Am-Cm-Am-Am-Gm-Af-Am-Af-Am-Am-Cm-Cm-Cms-Cms-Gm | 232 | 70 |
| B208 | B208-DV27P | Gms-Gms-Gm-Um-Um-Um-Uf-Um-Cf-Uf-Uf-Gm-Um-Um-Gm-Am-Cf-Am-Am-Gm-Am | 122 | 38 | UmsEVP-Cfs-Um-Uf-Gf-Uf-Cm-Am-Am-Cm-Am-Am-Gm-Af-Am-Af-Am-Am-Cm-Cm-Cms-Cms-Gm | 231 | 70 |
| B208 | B208-DV28P | Gms-Gms-Gm-Um-Um-Um-Uf-Um-Cf-Um-Uf-Gm-Um-Um-Gm-Am-Cf-Am-Am-Gm-Am | 121 | 38 | UmsEVP-Cfs-Uf-Uf-Gm-Uf-Cm-Am-Am-Cm-Am-Am-Gm-Af-Am-Af-Am-Am-Cm-Cm-Cms-Cms-Gm | 232 | 70 |
| B208 | B208-DV32P | Gms-Gms-Gm-Um-Um-Um-Uf-Um-Cf-Um-Uf-Gm-Um-Um-Gm-Am-Cf-Am-Am-Gm-Am | 121 | 38 | UmsEVP-Cfs-Um-Um-Gf-Uf-Cm-Am-Am-Cm-Am-Am-Gm-Af-Am-Af-Am-Am-Cm-Cm-Cms-Cms-Gm | 233 | 70 |
| B208 | B208-DV34P | Gms-Gms-Gm-Um-Um-Um-Uf-Um-Cf-Um-Uf-Gm-Um-Um-Gm-Am-Cf-Am-Am-Gm-Am | 121 | 38 | UmsEVP-Cfs-Uf-Um-Gm-Uf-Cm-Am-Am-Cm-Am-Am-Gm-Af-Am-Af-Am-Am-Cm-Cm-Cms-Cms-Gm | 234 | 70 |
| B208 | B208-DV30P | Gms-Gms-Gm-Um-Um-Um-Uf-Um-Cf-Uf-Uf-Gm-Um-Um-Gm-Am-Cm-Am-Am-Gm-Am | 123 | 38 | UmsEVP-Cfs-Um-Um-Gm-Uf-Cm-Am-Am-Cm-Am-Am-Gm-Af-Am-Am-Am-Am-Cm-Cm-Cms-Cms-Gm | 235 | 70 |
| B208 | B208-DV31P | Gms-Gms-Gm-Um-Um-Um-Uf-Um-Cf-Uf-Um-Gm-Um-Um-Gm-Am-Cm-Am-Am-Gm-Am | 124 | 38 | UmsEVP-Cfs-Um-Um-Gm-Uf-Cm-Am-Am-Cm-Am-Am-Gm-Af-Am-Af-Am-Am-Cm-Cm-Cms-Cms-Gm | 236 | 70 |

TABLE 11-continued

Sequences modified with different modification templates

| Unmodified sequence code | Sequence code | Sense strand sequence 5'-3' | Sequence ID No | Unmodified sequence ID No | Antisense strand sequence 5'-3' | Sequence ID No | Unmodified sequence ID No |
|---|---|---|---|---|---|---|---|
| B208 | B208-DV21P | Gms-Gms-Gm-Um-Um-Um-Uf-Um-Cf-Uf-Uf-Gm-Um-Um-Gm-Af-Cf-Am-Am-Gm-Am | 125 | 38 | UmsEVP-Cfs-Um-Um-Gm-Uf-Cm-Am-Am-Cm-Am-Am-Gm-Af-Am-Af-Am-Am-Cm-Cm-Cms-Cms-Gm | 236 | 70 |
| B208 | B208-DV22P | Gms-Gms-Gm-Um-Um-Um-Uf-Um-Cf-Uf-Uf-Gm-Um-Um-Gm-Am-Cm-Am-Am-Gm-Am | 123 | 38 | UmsEVP-Cfs-Um-Um-Gm-Uf-Cm-Am-Am-Cm-Am-Am-Gm-Af-Am-Af-Am-Am-Cm-Cm-Cms-Cms-Gm | 236 | 70 |
| B262 | B262-DV29P | Ums-Gms-Gm-Am-Cm-Um-Uf-Cm-Uf-Cm-Uf-Cm-Am-Am-Um-Um-Uf-Um-Cm-Um-Am | 131 | 39 | UmsEVP-Afs-Gm-Af-Af-Af-Am-Um-Um-Gm-Am-Gm-Am-Gf-Am-Af-Gm-Um-Cm-Cm-Ams-Cms-Gm | 243 | 71 |
| B262 | B262-DV26P | Ums-Gms-Gm-Am-Cm-Um-Uf-Cm-Uf-Cf-Uf-Cm-Am-Am-Um-Um-Uf-Um-Cm-Um-Am | 132 | 39 | UmsEVP-Afs-Gf-Af-Am-Af-Am-Um-Um-Gm-Am-Gm-Am-Gf-Am-Af-Gm-Um-Cm-Cm-Ams-Cms-Gm | 244 | 71 |
| B262 | B262-DV27P | Ums-Gms-Gm-Am-Cm-Um-Uf-Cm-Uf-Cf-Uf-Cm-Am-Am-Um-Um-Uf-Um-Cm-Um-Am | 132 | 39 | UmsEVP-Afs-Gm-Af-Af-Af-Am-Um-Um-Gm-Am-Gm-Am-Gf-Am-Af-Gm-Um-Cm-Cm-Ams-Cms-Gm | 243 | 71 |
| B262 | B262-DV28P | Ums-Gms-Gm-Am-Cm-Um-Uf-Cm-Uf-Cm-Uf-Cm-Am-Am-Um-Um-Uf-Um-Cm-Um-Am | 131 | 39 | UmsEVP-Afs-Gf-Af-Am-Af-Am-Um-Um-Gm-Am-Gm-Am-Gf-Am-Af-Gm-Um-Cm-Cm-Ams-Cms-Gm | 244 | 71 |
| B262 | B262-DV32P | Ums-Gms-Gm-Am-Cm-Um-Uf-Cm-Uf-Cm-Uf-Cm-Am-Am-Um-Um-Uf-Um-Cm-Um-Am | 131 | 39 | UmsEVP-Afs-Gm-Am-Af-Af-Am-Um-Um-Gm-Am-Gm-Am-Gf-Am-Af-Gm-Um-Cm-Cm-Ams-Cms-Gm | 245 | 71 |
| B262 | B262-DV34P | Ums-Gms-Gm-Am-Cm-Um-Uf-Cm-Uf-Cm-Uf-Cm-Am-Am-Um-Um-Uf-Um-Cm-Um-Am | 131 | 39 | UmsEVP-Afs-Gf-Am-Am-Af-Am-Um-Um-Gm-Am-Gm-Am-Gf-Am-Af-Gm-Um-Cm-Cm-Ams-Cms-Gm | 246 | 71 |
| B262 | B262-DV30P | Ums-Gms-Gm-Am-Cm-Um-Uf-Cm-Uf-Cf-Uf-Cm-Am-Am-Um-Um-Um-Um-Cm-Um-Am | 133 | 39 | UmsEVP-Afs-Gm-Am-Am-Af-Am-Um-Um-Gm-Am-Gm-Am-Gf-Am-Am-Gm-Um-Cm-Cm-Ams-Cms-Gm | 247 | 71 |
| B262 | B262-DV31P | Ums-Gms-Gm-Am-Cm-Um-Uf-Cm-Uf-Cf-Um-Cm-Am-Am-Um-Um-Um-Um-Cm-Um-Am | 134 | 39 | UmsEVP-Afs-Gm-Am-Am-Af-Am-Um-Um-Gm-Am-Gm-Am-Gf-Am-Af-Gm-Um-Cm-Cm-Ams-Cms-Gm | 248 | 71 |
| B262 | B262-DV21P | Ums-Gms-Gm-Am-Cm-Um-Uf-Cm-Uf-Cf-Uf-Cm-Am-Am-Um-Uf-Uf-Um-Cm-Um-Am | 135 | 39 | UmsEVP-Afs-Gm-Am-Am-Af-Am-Um-Um-Gm-Am-Gm-Am-Gf-Am-Af-Gm-Um-Cm-Cm-Ams-Cms-Gm | 248 | 71 |
| B262 | B262-DV22P | Ums-Gms-Gm-Am-Cm-Um-Uf-Cm-Uf-Cf-Uf-Cm-Am-Am-Um-Um-Um-Um-Cm-Um-Am | 133 | 39 | UmsEVP-Afs-Gm-Am-Am-Af-Am-Um-Um-Gm-Am-Gm-Am-Gf-Am-Af-Gm-Um-Cm-Cm-Ams-Cms-Gm | 248 | 71 |
| B264 | B264-DV29P | Gms-Ams-Cm-Um-Um-Cm-Uf-Cm-Uf-Cm-Af-Am-Um-Um-Um-Um-Cf-Um-Am-Gm-Am | 136 | 40 | UmsEVP-Cfs-Um-Af-Gf-Af-Am-Am-Am-Um-Um-Gm-Am-Gf-Am-Gf-Am-Am-Gm-Um-Cms-Cms-Am | 249 | 72 |
| B264 | B264-DV26P | Gms-Ams-Cm-Um-Um-Cm-Uf-Cm-Uf-Cf-Af-Am-Um-Um-Um-Um-Cf-Um-Am-Gm-Am | 137 | 40 | UmsEVP-Cfs-Uf-Af-Gm-Af-Am-Am-Am-Um-Um-Gm-Am-Gf-Am-Gf-Am-Am-Gm-Um-Cms-Cms-Am | 250 | 72 |

TABLE 11-continued

Sequences modified with different modification templates

| Unmodified sequence code | Sequence code | Sense strand sequence 5'-3' | Sequence ID No | Unmodified sequence ID No | Antisense strand sequence 5'-3' | Sequence ID No | Unmodified sequence ID No |
|---|---|---|---|---|---|---|---|
| B264 | B264-DV27P | Gms-Ams-Cm-Um-Um-Cm-Uf-Cm-Uf-Cf-Af-Am-Um-Um-Um-Um-Cf-Um-Am-Gm-Am | 137 | 40 | UmsEVP-Cfs-Um-Af-Gf-Af-Am-Am-Am-Um-Um-Gm-Am-Gf-Am-Gf-Am-Am-Gm-Um-Cms-Cms-Am | 249 | 72 |
| B264 | B264-DV28P | Gms-Ams-Cm-Um-Um-Cm-Uf-Cm-Uf-Cm-Af-Am-Um-Um-Um-Um-Cf-Um-Am-Gm-Am | 136 | 40 | UmsEVP-Cfs-Uf-Af-Gm-Af-Am-Am-Am-Um-Um-Gm-Am-Gf-Am-Gf-Am-Am-Gm-Um-Cms-Cms-Am | 250 | 72 |
| B264 | B264-DV32P | Gms-Ams-Cm-Um-Um-Cm-Uf-Cm-Uf-Cm-Af-Am-Um-Um-Um-Um-Cf-Um-Am-Gm-Am | 136 | 40 | UmsEVP-Cfs-Um-Am-Gf-Af-Am-Am-Am-Um-Um-Gm-Am-Gf-Am-Gf-Am-Am-Gm-Um-Cms-Cms-Am | 251 | 72 |
| B264 | B264-DV34P | Gms-Ams-Cm-Um-Um-Cm-Uf-Cm-Uf-Cm-Af-Am-Um-Um-Um-Um-Cf-Um-Am-Gm-Am | 136 | 40 | UmsEVP-Cfs-Uf-Am-Gm-Af-Am-Am-Am-Um-Um-Gm-Am-Gf-Am-Gf-Am-Am-Gm-Um-Cms-Cms-Am | 252 | 72 |
| B264 | B264-DV30P | Gms-Ams-Cm-Um-Um-Cm-Uf-Cm-Uf-Cf-Af-Am-Um-Um-Um-Um-Cm-Um-Am-Gm-Am | 138 | 40 | UmsEVP-Cfs-Um-Am-Gm-Af-Am-Am-Am-Um-Um-Gm-Am-Gf-Am-Gm-Am-Am-Gm-Um-Cms-Cms-Am | 253 | 72 |
| B264 | B264-DV31P | Gms-Ams-Cm-Um-Um-Cm-Uf-Cm-Uf-Cf-Am-Am-Um-Um-Um-Um-Cm-Um-Am-Gm-Am | 139 | 40 | UmsEVP-Cfs-Um-Am-Gm-Af-Am-Am-Am-Um-Um-Gm-Am-Gf-Am-Gf-Am-Am-Gm-Um-Cms-Cms-Am | 254 | 72 |
| B264 | B264-DV21P | Gms-Ams-Cm-Um-Um-Cm-Uf-Cm-Uf-Cf-Af-Am-Um-Um-Um-Uf-Cf-Um-Am-Gm-Am | 140 | 40 | UmsEVP-Cfs-Um-Am-Gm-Af-Am-Am-Am-Um-Um-Gm-Am-Gf-Am-Gf-Am-Am-Gm-Um-Cms-Cms-Am | 254 | 72 |
| B264 | B264-DV22P | Gms-Ams-Cm-Um-Um-Cm-Uf-Cm-Uf-Cf-Af-Am-Um-Um-Um-Um-Cm-Um-Am-Gm-Am | 138 | 40 | UmsEVP-Cfs-Um-Am-Gm-Af-Am-Am-Am-Um-Um-Gm-Am-Gf-Am-Gf-Am-Am-Gm-Um-Cms-Cms-Am | 254 | 72 |
| B1556 | B1556-DV29P | Ums-Gms-Um-Gm-Cm-Cm-Uf-Um-Cf-Um-Cf-Am-Um-Cm-Um-Gm-Cf-Cm-Gm-Gm-Am | 141 | 41 | UmsEVP-Cfs-Cm-Gf-Gf-Cf-Am-Gm-Am-Um-Gm-Am-Gm-Af-Am-Gf-Gm-Cm-Am-Cm-Ams-Gms-Am | 255 | 73 |
| B1556 | B1556-DV26P | Ums-Gms-Um-Gm-Cm-Cm-Uf-Um-Cf-Uf-Cf-Am-Um-Cm-Um-Gm-Cf-Cm-Gm-Gm-Am | 142 | 41 | UmsEVP-Cfs-Cf-Gf-Gm-Cf-Am-Gm-Am-Um-Gm-Am-Gm-Af-Am-Gf-Gm-Cm-Am-Cm-Ams-Gms-Am | 256 | 73 |
| B1556 | B1556-DV27P | Ums-Gms-Um-Gm-Cm-Cm-Uf-Um-Cf-Uf-Cf-Am-Um-Cm-Um-Gm-Cf-Cm-Gm-Gm-Am | 142 | 41 | UmsEVP-Cfs-Cm-Gf-Gf-Cf-Am-Gm-Am-Um-Gm-Am-Gm-Af-Am-Gf-Gm-Cm-Am-Cm-Ams-Gms-Am | 255 | 73 |
| B1556 | B1556-DV28P | Ums-Gms-Um-Gm-Cm-Cm-Uf-Um-Cf-Um-Cf-Am-Um-Cm-Um-Gm-Cf-Cm-Gm-Gm-Am | 141 | 41 | UmsEVP-Cfs-Cf-Gf-Gm-Cf-Am-Gm-Am-Um-Gm-Am-Gm-Af-Am-Gf-Gm-Cm-Am-Cm-Ams-Gms-Am | 256 | 73 |
| B1556 | B1556-DV32P | Ums-Gms-Um-Gm-Cm-Cm-Uf-Um-Cf-Um-Cf-Am-Um-Cm-Um-Gm-Cf-Cm-Gm-Gm-Am | 141 | 41 | UmsEVP-Cfs-Cm-Gm-Gf-Cf-Am-Gm-Am-Um-Gm-Am-Gm-Af-Am-Gf-Gm-Cm-Am-Cm-Ams-Gms-Am | 257 | 73 |
| B1556 | B1556-DV34P | Ums-Gms-Um-Gm-Cm-Cm-Uf-Um-Cf-Um-Cf-Am-Um-Cm-Um-Gm-Cf-Cm-Gm-Gm-Am | 141 | 41 | UmsEVP-Cfs-Cf-Gm-Gm-Cf-Am-Gm-Am-Um-Gm-Am-Gm-Af-Am-Gf-Gm-Cm-Am-Cm-Ams-Gms-Am | 258 | 73 |
| B1556 | B1556- | Ums-Gms-Um-Gm-Cm-Cm-Uf-Um-Cf-Uf-Cf-Am- | 143 | 41 | UmsEVP-Cfs-Cm-Gm-Gm-Cf-Am-Gm-Am-Um-Gm-Am-Gm- | 259 | 73 |

TABLE 11-continued

| Sequences modified with different modification templates | | | | | | | |
|---|---|---|---|---|---|---|---|
| Unmodified sequence code | Sequence code | Sense strand sequence 5'-3' | Sequence ID No | Unmodified sequence ID No | Antisense strand sequence 5'-3' | Sequence ID No | Unmodified sequence ID No |
| | DV 30P | Um-Cm-Um-Gm-Cm-Cm-Gm-Gm-Am | | | Af-Am-Gm-Gm-Cm-Am-Cm-Ams-Gms-Am | | |
| B1556 | B1556-DV31P | Ums-Gms-Um-Gm-Cm-Cm-Uf-Um-Cf-Uf-Cm-Am-Um-Cm-Um-Gm-Cm-Cm-Gm-Gm-Am | 144 | 41 | UmsEVP-Cfs-Cm-Gm-Gm-Cf-Am-Gm-Am-Um-Gm-Am-Gm-Af-Am-Gf-Gm-Cm-Am-Cm-Ams-Gms-Am | 260 | 73 |
| B1556 | B1556-DV21P | Ums-Gms-Um-Gm-Cm-Cm-Uf-Um-Cf-Uf-Cf-Am-Um-Cm-Um-Gf-Cf-Cm-Gm-Gm-Am | 145 | 41 | UmsEVP-Cfs-Cm-Gm-Gm-Cf-Am-Gm-Am-Um-Gm-Am-Gm-Af-Am-Gf-Gm-Cm-Am-Cm-Ams-Gms-Am | 260 | 73 |
| B1556 | B1556-DV22P | Ums-Gms-Um-Gm-Cm-Cm-Uf-Um-Cf-Uf-Cf-Am-Um-Cm-Um-Gm-Cm-Cm-Gm-Gm-Am | 143 | 41 | UmsEVP-Cfs-Cm-Gm-Gm-Cf-Am-Gm-Am-Um-Gm-Am-Gm-Af-Am-Gf-Gm-Cm-Am-Cm-Ams-Gms-Am | 260 | 73 |
| B1560 | B1560-DV29P | Cms-Cms-Um-Um-Cm-Um-Cf-Am-Uf-Cm-Uf-Gm-Cm-Cm-Gm-Gm-Af-Cm-Cm-Gm-Um | 146 | 42 | AmsEVP-Cfs-Gm-Gf-Uf-Cf-Cm-Gm-Gm-Cm-Am-Gm-Am-Uf-Gm-Af-Gm-Am-Am-Gm-Gms-Cms-Am | 261 | 74 |
| B1560 | B1560-DV26P | Cms-Cms-Um-Um-Cm-Um-Cf-Am-Uf-Cf-Uf-Gm-Cm-Cm-Gm-Gm-Af-Cm-Cm-Gm-Um | 147 | 42 | AmsEVP-Cfs-Gf-Gf-Um-Cf-Cm-Gm-Gm-Cm-Am-Gm-Am-Uf-Gm-Af-Gm-Am-Am-Gm-Gms-Cms-Am | 262 | 74 |
| B1560 | B1560-DV27P | Cms-Cms-Um-Um-Cm-Um-Cf-Am-Uf-Cf-Uf-Gm-Cm-Cm-Gm-Gm-Af-Cm-Cm-Gm-Um | 147 | 42 | AmsEVP-Cfs-Gm-Gf-Uf-Cf-Cm-Gm-Gm-Cm-Am-Gm-Am-Uf-Gm-Af-Gm-Am-Am-Gm-Gms-Cms-Am | 261 | 74 |
| B1560 | B1560-DV28P | Cms-Cms-Um-Um-Cm-Um-Cf-Am-Uf-Cm-Uf-Gm-Cm-Cm-Gm-Gm-Af-Cm-Cm-Gm-Um | 146 | 42 | AmsEVP-Cfs-Gf-Gf-Um-Cf-Cm-Gm-Gm-Cm-Am-Gm-Am-Uf-Gm-Af-Gm-Am-Am-Gm-Gms-Cms-Am | 262 | 74 |
| B1560 | B1560-DV32P | Cms-Cms-Um-Um-Cm-Um-Cf-Am-Uf-Cm-Uf-Gm-Cm-Cm-Gm-Gm-Af-Cm-Cm-Gm-Um | 146 | 42 | AmsEVP-Cfs-Gm-Gm-Uf-Cf-Cm-Gm-Gm-Cm-Am-Gm-Am-Uf-Gm-Af-Gm-Am-Am-Gm-Gms-Cms-Am | 263 | 74 |
| B1560 | B1560-DV34P | Cms-Cms-Um-Um-Cm-Um-Cf-Am-Uf-Cm-Uf-Gm-Cm-Cm-Gm-Gm-Af-Cm-Cm-Gm-Um | 146 | 42 | AmsEVP-Cfs-Gf-Gm-Um-Cf-Cm-Gm-Gm-Cm-Am-Gm-Am-Uf-Gm-Af-Gm-Am-Am-Gm-Gms-Cms-Am | 264 | 74 |
| B1560 | B1560-DV30P | Cms-Cms-Um-Um-Cm-Um-Cf-Am-Uf-Cf-Uf-Gm-Cm-Cm-Gm-Gm-Am-Cm-Cm-Gm-Um | 148 | 42 | AmsEVP-Cfs-Gm-Gm-Um-Cf-Cm-Gm-Gm-Cm-Am-Gm-Am-Uf-Gm-Am-Gm-Am-Am-Gm-Gms-Cms-Am | 265 | 74 |
| B1560 | B1560-DV31P | Cms-Cms-Um-Um-Cm-Um-Cf-Am-Uf-Cf-Um-Gm-Cm-Cm-Gm-Gm-Am-Cm-Cm-Gm-Um | 149 | 42 | AmsEVP-Cfs-Gm-Gm-Um-Cf-Cm-Gm-Gm-Cm-Am-Gm-Am-Uf-Gm-Af-Gm-Am-Am-Gm-Gms-Cms-Am | 266 | 74 |
| B1560 | B1560-DV21P | Cms-Cms-Um-Um-Cm-Um-Cf-Am-Uf-Cf-Uf-Gm-Cm-Cm-Gm-Gf-Af-Cm-Cm-Gm-Um | 150 | 42 | AmsEVP-Cfs-Gm-Gm-Um-Cf-Cm-Gm-Gm-Cm-Am-Gm-Am-Uf-Gm-Af-Gm-Am-Am-Gm-Gms-Cms-Am | 266 | 74 |
| B1560 | B1560-DV22P | Cms-Cms-Um-Um-Cm-Um-Cf-Am-Uf-Cf-Uf-Gm-Cm-Cm-Gm-Gm-Am-Cm-Cm-Gm-Um | 148 | 42 | AmsEVP-Cfs-Gm-Gm-Um-Cf-Cm-Gm-Gm-Cm-Am-Gm-Am-Uf-Gm-Af-Gm-Am-Am-Gm-Gms-Cms-Am | 266 | 74 |
| B416S | B416S-DV29P | Ums-Gms-Cm-Um-Gm-Cf-Um-Af-Um-Gf-Cm-Cm-Um-Cm-Am-Uf-Cm-Um-Um-Am | 151 | 43 | UmsEVP-Afs-Am-Gf-Af-Uf-Gm-Am-Gm-Gm-Cm-Am-Um-Af-Gm-Cf-Am-Gm-Cm-Ams-Gms-Gm | 267 | 75 |

TABLE 11-continued

Sequences modified with different modification templates

| Unmodified sequence code | Sequence code | Sense strand sequence 5'-3' | Sequence ID No | Unmodified sequence ID No | Antisense strand sequence 5'-3' | Sequence ID No | Unmodified sequence ID No |
|---|---|---|---|---|---|---|---|
| B416S | B416S-DV26P | Ums-Gms-Cm-Um-Gm-Cf-Um-Af-Uf-Gf-Cm-Cm-Um-Cm-Am-Uf-Cm-Um-Um-Am | 152 | 43 | UmsEVP-Afs-Af-Gf-Am-Uf-Gm-Am-Gm-Gm-Cm-Am-Um-Af-Gm-Cf-Am-Gm-Cm-Ams-Gms-Gm | 268 | 75 |
| B416S | B416S-DV27P | Ums-Gms-Cm-Um-Gm-Cf-Um-Af-Uf-Gf-Cm-Cm-Um-Cm-Am-Uf-Cm-Um-Um-Am | 152 | 43 | UmsEVP-Afs-Am-Gf-Af-Uf-Gm-Am-Gm-Gm-Cm-Am-Um-Af-Gm-Cf-Am-Gm-Cm-Ams-Gms-Gm | 267 | 75 |
| B416S | B416S-DV28P | Ums-Gms-Cm-Um-Gm-Cf-Um-Af-Um-Gf-Cm-Cm-Um-Cm-Am-Uf-Cm-Um-Um-Am | 151 | 43 | UmsEVP-Afs-Af-Gf-Am-Uf-Gm-Am-Gm-Gm-Cm-Am-Um-Af-Gm-Cf-Am-Gm-Cm-Ams-Gms-Gm | 268 | 75 |
| B416S | B416S-DV32P | Ums-Gms-Cm-Um-Gm-Cf-Um-Af-Um-Gf-Cm-Cm-Um-Cm-Am-Uf-Cm-Um-Um-Am | 151 | 43 | UmsEVP-Afs-Am-Gm-Af-Uf-Gm-Am-Gm-Gm-Cm-Am-Um-Af-Gm-Cf-Am-Gm-Cm-Ams-Gms-Gm | 269 | 75 |
| B416S | B416S-DV34P | Ums-Gms-Cm-Um-Gm-Cf-Um-Af-Um-Gf-Cm-Cm-Um-Cm-Am-Uf-Cm-Um-Um-Am | 151 | 43 | UmsEVP-Afs-Af-Gm-Am-Uf-Gm-Am-Gm-Gm-Cm-Am-Um-Af-Gm-Cf-Am-Gm-Cm-Ams-Gms-Gm | 270 | 75 |
| B416S | B416S-DV30P | Ums-Gms-Cm-Um-Gm-Cf-Um-Af-Uf-Gf-Cm-Cm-Um-Cm-Am-Um-Cm-Um-Um-Am | 153 | 43 | UmsEVP-Afs-Am-Gm-Am-Uf-Gm-Am-Gm-Gm-Cm-Am-Um-Af-Gm-Cm-Am-Gm-Cm-Ams-Gms-Gm | 271 | 75 |
| B416S | B416S-DV31P | Ums-Gms-Cm-Um-Gm-Cf-Um-Af-Uf-Gm-Cm-Cm-Um-Cm-Am-Um-Cm-Um-Um-Am | 154 | 43 | UmsEVP-Afs-Am-Gm-Am-Uf-Gm-Am-Gm-Gm-Cm-Am-Um-Af-Gm-Cf-Am-Gm-Cm-Ams-Gms-Gm | 272 | 75 |
| B416S | B416S-DV21P | Ums-Gms-Cm-Um-Gm-Cf-Um-Af-Uf-Gf-Cm-Cm-Um-Cm-Af-Uf-Cm-Um-Um-Am | 155 | 43 | UmsEVP-Afs-Am-Gm-Am-Uf-Gm-Am-Gm-Gm-Cm-Am-Um-Af-Gm-Cf-Am-Gm-Cm-Ams-Gms-Gm | 272 | 75 |
| B416S | B416S-DV22P | Ums-Gms-Cm-Um-Gm-Cf-Um-Af-Uf-Gf-Cm-Cm-Um-Cm-Am-Um-Cm-Um-Um-Am | 153 | 43 | UmsEVP-Afs-Am-Gm-Am-Uf-Gm-Am-Gm-Gm-Cm-Am-Um-Af-Gm-Cf-Am-Gm-Cm-Ams-Gms-Gm | 272 | 75 |

2. Experimental Methods

Referring to Example 2, the concentration for the single-concentration screening experiment was set at 0.3 nM.

3. Experimental Results

The experimental results demonstrated that the sequences B207S-DV32P, A1550-DV27P, B1572-DV27P, B1575-DV27P, B207S-DV29P, A1573-DV29P, B1575-DV29P, B418S-DV34P, and A416-DV27P exhibited significantly superior inhibitory effects on HBsAg compared to the positive control sequence, as well as significantly superior inhibitory effects on HBeAg compared to the positive control sequence.

The inhibition rates of each sequence on the expression of HBsAg and HBeAg at a single concentration, as well as their relative inhibition rates compared to the positive control sequence APC-VIR, are shown in Table 12-41. The comprehensive ranking represents the inhibition rate ranking of the sequences relative to the positive control.

The single-concentration screening results indicated that some unmodified sequences modified with the templates DV25P-29P and DV32P-34P of the present disclosure demonstrated superior inhibitory effects on HBsAg and HBeAg compared to the positive control sequence. Among them, the modified sequences designed from the unmodified sequences B207S and B1575 ranked highest in terms of HBsAg inhibition rate, demonstrating the sensitivity of these target sites. Specifically, the sequences B207S-DV29P, B207S-DV32P, B1575-DV29P, B1575-DV26P, and B1575-DV27P all achieved HBsAg inhibition rates exceeding 90%. For example, the sequences B207S-DV29P and B1575-DV29P achieved HBsAg inhibition rates of 92.11% and 91.78%, respectively. Similarly, the modified sequences designed from the unmodified sequences B1575 and A1573 ranked highest in terms of HBeAg inhibition rate, demonstrating the sensitivity of these target sites. Specifically, the sequences B1575-DV29P, B1575-DV26P, B1575-DV27P, and B1575-DV32P all achieved HBeAg inhibition rates exceeding 60%.

The activity of the same siRNA sequence can vary significantly when modified with different templates. For example, the unmodified sequence B1556 modified with the template DV27P of the present disclosure showed an increase in HBsAg inhibition rate by 48.63% compared to modification with the template DV28P of the present disclosure, indicating a significant improvement.

Despite having similar unmodified sequences, the sensitivity to different modification templates varies. For example, the unmodified sequence B1572 modified with the template DV27P of the present disclosure achieved the highest inhibition rates for both HBsAg and HBeAg, while the unmodified sequences A1573 and B1575 achieved the highest inhibition rates for HBsAg and HBeAg when modified with the template DV29P. This demonstrates that it is uncertain which modification template will result in high activity for a given siRNA sequence.

The IC50 experimental results and cytotoxicity data for each sequence are shown in Table 42. The experimental results showed that the IC50 values of the 11 sequences tested for HBsAg ranged from 0.05 nM to 0.15 nM, all of which were lower than the IC50 value of the positive control sequence (0.3362 nM), demonstrating superior inhibitory effects compared to the positive control. For example, the IC50 values of B1572-DV27P, B1550-DV27P, and B207S-DV32P for HBsAg were 0.0538 nM, 0.0570 nM, and 0.0572 nM, respectively. Except for the sequence B261-DV26P, the IC50 values of the remaining 10 sequences for HBeAg ranged from 0.2 nM to 0.85 nM, all of which were lower than the IC50 value of the positive control sequence (1.89 nM), demonstrating superior inhibitory effects compared to the positive control. For example, the IC50 values of B1550-DV27P, B1572-DV27P, and B1575-DV26P for HBeAg were 0.2073 nM, 0.2143 nM, and 0.2923 nM, respectively. The cytotoxicity results showed that all 11 sequences exhibited cell viability greater than 90% at the highest tested concentration of 10 nM, indicating no significant cytotoxicity and suggesting a wide concentration range for selection.

Based on the comprehensive results, the following 10 sequences can be selected as candidate sequences: B207S-DV29P, B207S-DV32P, B1575-DV29P, B1575-DV26P, B1575-DV27P, B1572-DV27P, B1573-DV29P, B1550-DV27P, B416-DV27P, and B418S-DV34P.

(i) Inhibition of HBsAg and HBeAg by Unmodified Sequences Modified with Templates (1) Unmodified Sequence A1550

TABLE 12

HBsAg inhibition rates of unmodified sequence A1550 modified with templates

| unmodified sequence code | Modification template | Sequence code | HBsAg inhibition rate (%) | Maximum improvement over prior art templates (%) |
|---|---|---|---|---|
| A1550 | Modification templates of the present disclosure | A1550-DV29P | 83.37 | 21.62 |
| | | B1550-DV26P | 87.11 | 25.36 |
| | | B1550-DV27P | 87.26 | 25.51 |
| | | B1550-DV28P | 75.18 | 13.43 |
| | | B1550-DV32P | 80.13 | 18.38 |
| | | B1550-DV33P | 82.73 | 20.98 |
| | | B1550-DV34P | 83.03 | 21.28 |
| | | B1550-DV25P | 83.46 | 21.71 |
| | Prior art modification templates | B1550-DV30P | 68.31 | NA |
| | | B1550-DV31P | 61.75 | NA |
| | | B1550-DV21P | 62.24 | NA |
| | | B1550-DV22P | 68.71 | NA |

TABLE 13

HBeAg inhibition rates of unmodified sequence A1550 modified with templates

| unmodified sequence code | Modification template | Sequence code | HBeAg inhibition rate (%) | Maximum improvement over prior art templates (%) |
|---|---|---|---|---|
| A1550 | Modification templates of the present disclosure | A1550-DV29P | 46.07 | 20.17 |
| | | B1550-DV26P | 50.67 | 24.77 |
| | | B1550-DV27P | 52.45 | 26.55 |
| | | B1550-DV28P | 38.47 | 12.57 |
| | | B1550-DV32P | 43.41 | 17.51 |
| | | B1550-DV33P | 44.94 | 19.04 |
| | | B1550-DV34P | 46.22 | 20.32 |
| | | B1550-DV25P | 46.23 | 20.33 |
| | Prior art modification templates | B1550-DV30P | 29.23 | NA |
| | | B1550-DV31P | 26.28 | NA |
| | | B1550-DV21P | 25.90 | NA |
| | | B1550-DV22P | 33.52 | NA |

When the unmodified sequence A1550 was modified using the templates DV25P-29P and DV32P-34P of the present disclosure, the inhibition rates for both HBsAg and HBeAg were increased compared to those modified with prior art templates. For example, when modified with templates DV26P and DV27P, the sequences B1550-DV26P and B1550-DV27P showed increases in HBsAg inhibition rates by 25.36% and 25.51%, respectively, and increases in HBeAg inhibition rates by 24.77% and 26.55%, respectively. Detailed results are shown in Table 12 and Table 13.

(2) Unmodified Sequence B1556

TABLE 14

HBsAg inhibition rates of unmodified sequence B1556 modified with templates

| unmodified sequence code | Modification template | Sequence code | HBsAg inhibition rate (%) | Maximum improvement over prior art templates (%) |
|---|---|---|---|---|
| B1556 | Modification templates of the present disclosure | B1556-DV29P | 42.51 | 13.57 |
| | | B1556-DV26P | 66.4 | 37.46 |
| | | B1556-DV27P | 76.55 | 47.61 |
| | | B1556-DV28P | 27.92 | −1.02 |
| | | B1556-DV32P | 31.7 | 2.76 |
| | | B1556-DV34P | 32.09 | 3.15 |
| | Prior art modification templates | B1556-DV30P | 29.10 | NA |
| | | B1556-DV31P | 29.13 | NA |
| | | B1556-DV21P | 28.94 | NA |
| | | B1556-DV22P | 34.79 | NA |

TABLE 15

HBeAg inhibition rates of unmodified sequence B1556 modified with templates

| unmodified sequence code | Modification template | Sequence code | HBeAg inhibition rate (%) | Maximum improvement over prior art templates (%) |
|---|---|---|---|---|
| B1556 | Modification templates of the present disclosure | B1556-DV29P | 16.37 | 4.70 |
| | | B1556-DV26P | 36.96 | 25.29 |
| | | B1556-DV27P | 43.4 | 31.73 |
| | | B1556-DV28P | 8.87 | −2.80 |
| | | B1556-DV32P | 8.36 | −3.31 |
| | | B1556-DV34P | 9.71 | −1.96 |

TABLE 15-continued

HBeAg inhibition rates of unmodified sequence B1556 modified with templates

| unmodified sequence code | Modification template | Sequence code | HBeAg inhibition rate (%) | Maximum improvement over prior art templates (%) |
|---|---|---|---|---|
| | Prior art modification templates | B1556-DV30P | 12.52 | NA |
| | | B1556-DV31P | 11.67 | NA |
| | | B1556-DV21P | 12.28 | NA |
| | | B1556-DV22P | 20.42 | NA |

The unmodified sequence B1556 was modified using the templates DV26P-29P, DV32P and DV34P of the present disclosure. Compared with those modified with prior art templates, the sequences B1556-DV26P and B1556-DV27P modified with templates DV26P and DV27P showed increases in HBsAg inhibition rates by 37.46% and 47.61%, respectively, and increases in HBeAg inhibition rates by 25.29% and 31.73%, respectively. Detailed results are shown in Table 14 and Table 15.

(3) Unmodified Sequence B1560

TABLE 16

HBsAg inhibition rates of unmodified sequence B1560 modified with templates

| unmodified sequence code | Modification template | Sequence code | HBsAg inhibition rate (%) | Maximum improvement over prior art templates (%) |
|---|---|---|---|---|
| B1560 | Modification templates of the present disclosure | B1560-DV29P | 48.04 | 22.43 |
| | | B1560-DV26P | 61.43 | 35.82 |
| | | B1560-DV27P | 69.21 | 43.60 |
| | | B1560-DV28P | 30.71 | 5.10 |
| | | B1560-DV32P | 39.72 | 14.11 |
| | | B1560-DV34P | 33.94 | 8.33 |
| | Prior art modification templates | B1560-DV30P | 25.61 | NA |
| | | B1560-DV31P | 27.26 | NA |
| | | B1560-DV21P | 29.53 | NA |
| | | B1560-DV22P | 30.68 | NA |

TABLE 17

HBeAg inhibition rates of unmodified sequence B1560 modified with templates

| unmodified sequence code | Modification template | Sequence code | HBeAg inhibition rate (%) | Maximum improvement over prior art templates (%) |
|---|---|---|---|---|
| B1560 | Modification templates of the present disclosure | B1560-DV29P | 18.12 | 8.94 |
| | | B1560-DV26P | 30.02 | 20.84 |
| | | B1560-DV27P | 37.72 | 28.54 |
| | | B1560-DV28P | 12.67 | 3.49 |
| | | B1560-DV32P | 15.59 | 6.41 |
| | | B1560-DV34P | 14.96 | 5.78 |
| | Prior art modification templates | B1560-DV30P | 9.18 | NA |
| | | B1560-DV31P | 12.76 | NA |
| | | B1560-DV21P | 13.06 | NA |
| | | B1560-DV22P | 14.74 | NA |

The unmodified sequence B1560 was modified using the templates DV26P-29P, DV32P and DV34P of the present disclosure. Compared with those modified with prior art templates, the sequences B1560-DV26P and B1560-DV27P modified with templates DV26P and DV27P showed increases in HBsAg inhibition rates by 35.82% and 43.60%, respectively, and increases in HBeAg inhibition rates by 20.84% and 28.54%, respectively. Detailed results are shown in Table 16 and Table 17.

From this, the following conclusions can be drawn:

1) For the unmodified sequences A1550, B1556, and B1560, modification with the templates DV25P-29P and DV32P-34P of the present disclosure resulted in significantly superior inhibition of both HBsAg and HBeAg compared to those modified with prior art templates. When modified with DV26P and DV27P, the inhibition rates for HBsAg and HBeAg were the highest and significantly better than those achieved with prior art templates.

2) The activity of the same siRNA sequence can vary significantly when modified with different templates. For example, the unmodified sequence B1556 modified with the template DV27P of the present disclosure showed an increase in HBsAg inhibition rate by 48.63% compared to modification with the template DV28P of the present disclosure, indicating a significant improvement.

(3) siRNA sequences with similar sequences can exhibit vastly different levels of activity. For example, the DV29P-modified sequence A1550-DV29P showed a 40.86% higher HBsAg inhibition rate compared to A1556-DV29P.

(4) Unmodified Sequence B1572

TABLE 18

HBsAg inhibition rates of unmodified sequence B1572 modified with templates

| unmodified sequence code | Modification template | Sequence code | HBsAg inhibition rate (%) | Maximum improvement over prior art templates (%) |
|---|---|---|---|---|
| B1572 | Modification templates of the present disclosure | B1572-DV29P | 84 | 22.76 |
| | | B1572-DV26P | 88.08 | 26.84 |
| | | B1572-DV27P | 88.83 | 27.59 |
| | | B1572-DV28P | 80.65 | 19.41 |
| | | B1572-DV32P | 75.61 | 14.37 |
| | | B1572-DV34P | 78.58 | 17.34 |
| | Prior art modification templates | B1572-DV30P | 65.51 | NA |
| | | B1572-DV31P | 61.24 | NA |
| | | B1572-DV21P | 66.07 | NA |
| | | B1572-DV22P | 67.99 | NA |

TABLE 19

HBeAg inhibition rates of unmodified sequence B1572 modified with templates

| unmodified sequence code | Modification template | Sequence code | HBeAg inhibition rate (%) | Maximum improvement over prior art templates (%) |
|---|---|---|---|---|
| B1572 | Modification templates of the present disclosure | B1572-DV29P | 48.73 | 25.68 |
| | | B1572-DV26P | 55.07 | 32.02 |
| | | B1572-DV27P | 59.79 | 36.74 |
| | | B1572-DV28P | 46.44 | 23.39 |
| | | B1572-DV32P | 40.05 | 17.00 |
| | | B1572-DV34P | 43.26 | 20.21 |

TABLE 19-continued

HBeAg inhibition rates of unmodified sequence B1572 modified with templates

| unmodified sequence code | Modification template | Sequence code | HBeAg inhibition rate (%) | Maximum improvement over prior art templates (%) |
|---|---|---|---|---|
| | Prior art modification templates | B1572-DV30P | 34.57 | NA |
| | | B1572-DV31P | 23.05 | NA |
| | | B1572-DV21P | 35.98 | NA |
| | | B1572-DV22P | 40.04 | NA |

The unmodified sequence B1572 was modified using the templates DV26P-29P, DV32P and DV34P of the present disclosure. Compared with those modified with prior art templates, the sequences B1572-DV26P and B1572-DV27P modified with templates DV26P and DV27P showed increases in HBsAg inhibition rates by 26.84% and 27.59%, respectively, and increases in HBeAg inhibition rates by 32.02% and 36.74%, respectively. Detailed results are shown in Table 18 and Table 19.

(5) Unmodified Sequence A1573

TABLE 20

HBsAg inhibition rates of unmodified sequence A1573 modified with templates

| unmodified sequence code | Modification template | Sequence code | HBsAg inhibition rate (%) | Maximum improvement over prior art templates (%) |
|---|---|---|---|---|
| A1573 | Modification templates of the present disclosure | A1573-DV29P | 85.06 | 16.08 |
| | | B1573-DV26P | 81.89 | 12.91 |
| | | B1573-DV27P | 83.93 | 14.95 |
| | | B1573-DV28P | 82.81 | 13.83 |
| | | B1573-DV32P | 83.62 | 14.64 |
| | | B1573-DV34P | 79.2 | 10.22 |
| | Prior art modification templates | B1573-DV30P | 68.98 | NA |
| | | B1573-DV31P | 70.20 | NA |
| | | B1573-DV21P | 69.04 | NA |
| | | B1573-DV22P | 70.80 | NA |

TABLE 21

HBeAg inhibition rates of unmodified sequence A1573 modified with templates

| unmodified sequence code | Modification template | Sequence code | HBeAg inhibition rate (%) | Maximum improvement over prior art templates (%) |
|---|---|---|---|---|
| A1573 | Modification templates of the present disclosure | A1573-DV29P | 54.18 | 32.68 |
| | | B1573-DV26P | 51.74 | 30.24 |
| | | B1573-DV27P | 52.41 | 30.91 |
| | | B1573-DV28P | 51.01 | 29.51 |
| | | B1573-DV32P | 57.01 | 35.51 |
| | | B1573-DV34P | 47.76 | 26.26 |
| | Prior art modification templates | B1573-DV30P | 21.50 | NA |
| | | B1573-DV31P | 35.15 | NA |
| | | B1573-DV21P | 33.55 | NA |
| | | B1573-DV22P | 38.73 | NA |

When the unmodified sequence A1573 was modified using the templates DV26P-29P, DV32P, and DV34P of the present disclosure, the inhibition rates for both HBsAg and HBeAg were significantly improved compared to those modified with prior art templates. For example, when modified with the template DV29P, the sequence A1573-DV29P showed increases in HBsAg and HBeAg inhibition rates by 16.08% and 32.68%, respectively. Detailed results are shown in Table 20 and Table 21.

(6) Unmodified Sequence B1575

TABLE 22

HBsAg inhibition rates of unmodified sequence B1575 modified with templates

| unmodified sequence code | Modification template | Sequence code | HBsAg inhibition rate (%) | Maximum improvement over prior art templates (%) |
|---|---|---|---|---|
| B1575 | Modification templates of the present disclosure | B1575-DV29P | 91.78 | 31.19 |
| | | B1575-DV26P | 91.68 | 31.09 |
| | | B1575-DV27P | 90.82 | 30.23 |
| | | B1575-DV28P | 72.07 | 11.48 |
| | | B1575-DV32P | 90.1 | 29.51 |
| | | B1575-DV34P | 84.92 | 24.33 |
| | Prior art modification templates | B1575-DV30P | 60.59 | NA |
| | | B1575-DV31P | 70.37 | NA |
| | | B1575-DV21P | 68.59 | NA |
| | | B1575-DV22P | 66.48 | NA |

TABLE 23

HBeAg inhibition rates of unmodified sequence B1575 modified with templates

| unmodified sequence code | Modification template | Sequence code | HBeAg inhibition rate (%) | Maximum improvement over prior art templates (%) |
|---|---|---|---|---|
| B1575 | Modification templates of the present disclosure | B1575-DV29P | 66.21 | 46.17 |
| | | B1575-DV26P | 64.21 | 44.17 |
| | | B1575-DV27P | 63.29 | 43.25 |
| | | B1575-DV28P | 36.22 | 16.18 |
| | | B1575-DV32P | 61.94 | 41.90 |
| | | B1575-DV34P | 52.44 | 32.40 |
| | Prior art modification templates | B1575-DV30P | 20.04 | NA |
| | | B1575-DV31P | 32.98 | NA |
| | | B1575-DV21P | 31.35 | NA |
| | | B1575-DV22P | 25.77 | NA |

When the unmodified sequence B1575 was modified using the templates DV26P-29P, DV32P, and DV34P of the present disclosure, the inhibition rates for both HBsAg and HBeAg were significantly increased compared to those modified with prior art templates. For example, when modified with the template DV29P, the sequence B1575-DV29P showed increases in HBsAg and HBeAg inhibition rates by 31.19% and 46.17%, respectively. Detailed results are shown in Table 22 and Table 23.

From this, the following conclusions can be drawn:

1) The unmodified sequences B1572, A1573, and B1575, when modified with the templates DV26P-29P, DV32P and DV34P of the present disclosure, showed significantly superior inhibition of both HBsAg and HBeAg compared to those modified with prior art templates. For the unmodified sequence B1572, modification with the templates DV26P and DV27P of the present disclosure resulted in the highest inhibition rates for both HBsAg and HBeAg, significantly outperforming the prior art templates. For the unmodified sequences A1573 and B1575, modification with the template DV29P of the present disclosure resulted in the highest inhibition rates for both HBsAg and HBeAg, significantly outperforming the prior art templates.

2) The activity of the same siRNA sequence can vary significantly when modified with different templates. For example, the unmodified sequence B1575 modified with the template DV29P of the present disclosure showed an increase in HBsAg inhibition rate by 29.99% compared to modification with the template DV28P of the present disclosure, indicating a significant improvement.

3) In terms of siRNA with similar sequences, the sensitivity to different modification templates varies. For example, the unmodified sequence B1572 modified with the template DV27P of the present disclosure achieved the highest inhibition rates for both HBsAg and HBeAg, while the unmodified sequences A1573 and B1575 achieved the highest inhibition rates for HBsAg and HBeAg when modified with the template DV29P.

(7) Unmodified Sequence B205

TABLE 24

HBsAg inhibition rates of unmodified sequence B205 modified with templates

| unmodified sequence code | Modification template | Sequence code | HBsAg inhibition rate (%) | Maximum improvement over prior art templates (%) |
|---|---|---|---|---|
| B205 | Modification templates of the present disclosure | B205-DV29P | 68.34 | 26.41 |
| | | B205-DV26P | 75.67 | 33.74 |
| | | B205-DV27P | 65.28 | 23.35 |
| | | B205-DV28P | 78.48 | 36.55 |
| | | B205-DV32P | 76.03 | 34.10 |
| | | B205-DV34P | 76.35 | 34.42 |
| | Prior art modification templates | B205-DV30P | 48.57 | NA |
| | | B205-DV31P | 59.55 | NA |
| | | B205-DV21P | 44.86 | NA |
| | | B205-DV22P | 41.93 | NA |

TABLE 25

HBeAg inhibition rates of unmodified sequence B205 modified with templates

| unmodified sequence code | Modification template | Sequence code | HBeAg inhibition rate (%) | Maximum improvement over prior art templates (%) |
|---|---|---|---|---|
| B205 | Modification templates of the present disclosure | B205-DV29P | 35.59 | 25.00 |
| | | B205-DV26P | 34.02 | 23.43 |
| | | B205-DV27P | 30.57 | 19.98 |
| | | B205-DV28P | 35.95 | 25.36 |
| | | B205-DV32P | 34.96 | 24.37 |
| | | B205-DV34P | 30.3 | 19.71 |
| | Prior art modification templates | B205-DV30P | 23.71 | NA |
| | | B205-DV31P | 22.69 | NA |
| | | B205-DV21P | 10.59 | NA |
| | | B205-DV22P | 11.97 | NA |

When the unmodified sequence B205 was modified using the templates DV26P-29P, DV32P, and DV34P of the present disclosure, the inhibition rates for both HBsAg and HBeAg were significantly increased compared to those modified with prior art templates. For example, when modified with the template DV28P, the sequence B205-DV28P showed increases in HBsAg and HBeAg inhibition rates by 36.55% and 25.36%, respectively. Detailed results are shown in Table 24 and Table 25.

(8) Unmodified Sequence B207S

TABLE 26

HBsAg inhibition rates of unmodified sequence B207S modified with templates

| unmodified sequence code | Modification template | Sequence code | HBsAg inhibition rate (%) | Maximum improvement over prior art templates (%) |
|---|---|---|---|---|
| B207S | Modification templates of the present disclosure | B207S-DV29P | 92.11 | 35.37 |
| | | B207S-DV25P | 87.34 | 30.60 |
| | | B207S-DV26P | 81.17 | 24.43 |
| | | B207S-DV27P | 87.52 | 30.78 |
| | | B207S-DV28P | 82.1 | 25.36 |
| | | B207S-DV32P | 91.72 | 34.98 |
| | | B207S-DV33P | 86.65 | 29.91 |
| | | B207S-DV34P | 81.63 | 24.89 |
| | Prior art modification templates | B207S-DV30P | 63.08 | NA |
| | | B207S-DV31P | 70.31 | NA |
| | | B207S-DV21P | 56.74 | NA |
| | | B207S-DV22P | 57.75 | NA |

TABLE 27

HBeAg inhibition rates of unmodified sequence B207S modified with templates

| unmodified sequence code | Modification template | Sequence code | HBeAg inhibition rate (%) | Maximum improvement over prior art templates (%) |
|---|---|---|---|---|
| B207S | Modification templates of the present disclosure | B207S-DV29P | 55.18 | 26.71 |
| | | B207S-DV25P | 43.85 | 15.38 |
| | | B207S-DV26P | 45.81 | 17.34 |
| | | B207S-DV27P | 45.77 | 17.30 |
| | | B207S-DV28P | 45.55 | 17.08 |
| | | B207S-DV32P | 47.42 | 18.95 |
| | | B207S-DV33P | 46.85 | 18.38 |
| | | B207S-DV34P | 40.38 | 11.91 |
| | Prior art modification templates | B207S-DV30P | 30.60 | NA |
| | | B207S-DV31P | 33.35 | NA |
| | | B207S-DV21P | 28.47 | NA |
| | | B207S-DV22P | 30.55 | NA |

When the unmodified sequence B207S was modified using the templates DV25P-29P and DV32P-34P of the present disclosure, the inhibition rates for both HBsAg and HBeAg were significantly improved compared to those modified with prior art templates. For example, when modified with the templates DV29P and DV32P, the sequence B207S-DV29P showed increases in HBsAg and HBeAg inhibition rates by 35.37% and 26.71%, respectively; the sequence B207S-DV32P showed increases in HBsAg and HBeAg inhibition rates by 34.98% and 18.95%. Detailed results are shown in Table 26 and Table 27.

(9) Unmodified Sequence B208

TABLE 28

HBsAg inhibition rates of unmodified sequence B208 modified with templates

| unmodified sequence code | Modification template | Sequence code | HBsAg inhibition rate (%) | Maximum improvement over prior art templates (%) |
|---|---|---|---|---|
| B208 | Modification templates of the present disclosure | B208-DV29P | 46.27 | 15.67 |
| | | B208-DV26P | 68.23 | 37.63 |
| | | B208-DV27P | 54.29 | 23.69 |
| | | B208-DV28P | 56.83 | 26.23 |
| | | B208-DV32P | 42.13 | 11.53 |
| | | B208-DV34P | 50.56 | 19.96 |
| | Prior art modification templates | B208-DV30P | 44.91 | NA |
| | | B208-DV31P | 30.60 | NA |
| | | B208-DV21P | 33.26 | NA |
| | | B208-DV22P | 40.66 | NA |

TABLE 29

HBeAg inhibition rates of unmodified sequence B208 modified with templates

| unmodified sequence code | Modification template | Sequence code | HBeAg inhibition rate (%) | Maximum improvement over prior art templates (%) |
|---|---|---|---|---|
| B208 | Modification templates of the present disclosure | B208-DV29P | 24.28 | 2.21 |
| | | B208-DV26P | 41.45 | 19.38 |
| | | B208-DV27P | 29.87 | 7.80 |
| | | B208-DV28P | 25.44 | 3.37 |
| | | B208-DV32P | 18.1 | −3.97 |
| | | B208-DV34P | 21.98 | −0.09 |
| | Prior art modification templates | B208-DV30P | 31.71 | NA |
| | | B208-DV31P | 23.35 | NA |
| | | B208-DV21P | 22.07 | NA |
| | | B208-DV22P | 29.90 | NA |

The unmodified sequence B208 was modified using the templates DV26P-29P, DV32P, and DV34P of the present disclosure. Compared with those modified with prior art templates, the sequence B208-DV26P modified with the template DV26P showed the most significant improvement, with HBsAg and HBeAg inhibition rates increasing by 37.63% and 19.38%, respectively. Detailed results are shown in Table 28 and Table 29.

From this, the following conclusions can be drawn:

1) For the unmodified sequences B205, B207S, and B208, modification with the templates DV25P-29P and DV32P-34P of the present disclosure resulted in significantly superior inhibition of both HBsAg and HBeAg compared to those modified with prior art templates. For the unmodified sequence B205, modification with the template DV28P of the present disclosure resulted in the highest inhibition rates for both HBsAg and HBeAg, significantly outperforming the prior art templates. For the unmodified sequence B207S, modification with the template DV29P of the present disclosure resulted in the highest inhibition rates for both HBsAg and HBeAg, significantly outperforming the prior art templates. For the unmodified sequence B208, modification with the template DV26P of the present disclosure resulted in the highest inhibition rates for both HBsAg and HBeAg, significantly outperforming the prior art templates.

2) The activity of the same siRNA sequence can vary significantly when modified with different templates. For example, the unmodified sequence B208 modified with the template DV26P of the present disclosure showed an increase in HBsAg inhibition rate by 21.96% compared to modification with the template DV29P of the present disclosure, indicating a significant improvement.

(3) siRNA sequences with similar sequences can exhibit vastly different levels of activity. For example, the DV29P-modified sequence B207S-DV29P showed a 45.84% higher HBsAg inhibition rate compared to B208-DV29P, and a 23.77% higher inhibition rate compared to B205-DV29P.

4) From this, it can be concluded that even for unmodified sequences with similar sequences, their sensitivity to different modification templates varies significantly. For example, the unmodified sequence B205 achieved the highest inhibition rates for HBsAg and HBeAg (78.48% and 35.95%, respectively) when modified with the disclosed template DV28P; the unmodified sequence B207S achieved the highest inhibition rates for HBsAg and HBeAg (92.11% and 55.18%, respectively) when modified with the disclosed template DV29P; the unmodified sequence B208 achieved the highest inhibition rates for HBsAg and HBeAg (68.23% and 41.45%, respectively) when modified with the disclosed template DV26P.

(10) Unmodified Sequence A261

TABLE 30

HBsAg inhibition rates of unmodified sequence A261 modified with templates

| unmodified sequence code | Modification template | Sequence code | HBsAg inhibition rate (%) | Maximum improvement over prior art templates (%) |
|---|---|---|---|---|
| A261 | Modification templates of the present disclosure | A261-DV29P | 84.47 | 15.69 |
| | | B261-DV26P | 85.6 | 16.82 |
| | | B261-DV27P | 84.26 | 15.48 |
| | | B261-DV28P | 81.34 | 12.56 |
| | | B261-DV32P | 80.89 | 12.11 |
| | | B261-DV34P | 82.06 | 13.28 |
| | Prior art modification templates | B261-DV30P | 68.78 | NA |
| | | B261-DV31P | 72.86 | NA |
| | | B261-DV21P | 76.75 | NA |
| | | B261-DV22P | 69.62 | NA |

TABLE 31

HBeAg inhibition rates of unmodified sequence A261 modified with templates

| unmodified sequence code | Modification template | Sequence code | HBeAg inhibition rate (%) | Maximum improvement over prior art templates (%) |
|---|---|---|---|---|
| A261 | Modification templates of the present disclosure | A261-DV29P | 23.83 | 13.40 |
| | | B261-DV26P | 22.32 | 11.89 |
| | | B261-DV27P | 26.27 | 15.84 |
| | | B261-DV28P | 18.94 | 8.51 |
| | | B261-DV32P | 22.46 | 12.03 |
| | | B261-DV34P | 18.75 | 8.32 |

TABLE 31-continued

HBeAg inhibition rates of unmodified sequence A261 modified with templates

| unmodified sequence code | Modification template | Sequence code | HBeAg inhibition rate (%) | Maximum improvement over prior art templates (%) |
|---|---|---|---|---|
| | Prior art modification templates | B261-DV30P | 10.43 | NA |
| | | B261-DV31P | 19.60 | NA |
| | | B261-DV21P | 20.88 | NA |
| | | B261-DV22P | 12.52 | NA |

When the unmodified sequence A261 was modified using the templates DV26P-29P, DV32P, and DV34P of the present disclosure, the inhibition rates for both HBsAg and HBeAg were significantly increased compared to those modified with prior art templates. For example, when modified with the template DV26P, the sequence B261-DV26P showed increases in HBsAg and HBeAg inhibition rates by 16.82% and 11.89%, respectively. Detailed results are shown in Table 30 and Table 31.

(11) Unmodified Sequence B262

TABLE 32

HBsAg inhibition rates of unmodified sequence B262 modified with templates

| unmodified sequence code | Modification template | Sequence code | HBsAg inhibition rate (%) | Maximum improvement over prior art templates (%) |
|---|---|---|---|---|
| B262 | Modification templates of the present disclosure | B262-DV29P | 44.26 | 3.62 |
| | | B262-DV26P | 68.98 | 28.34 |
| | | B262-DV27P | 56.51 | 15.87 |
| | | B262-DV28P | 69.63 | 28.99 |
| | | B262-DV32P | 64.54 | 23.90 |
| | | B262-DV34P | 64.63 | 23.99 |
| | Prior art modification templates | B262-DV30P | 40.64 | NA |
| | | B262-DV31P | 42.47 | NA |
| | | B262-DV21P | 41.43 | NA |
| | | B262-DV22P | 43.94 | NA |

TABLE 33

HBeAg inhibition rates of unmodified sequence B262 modified with templates

| unmodified sequence code | Modification template | Sequence code | HBeAg inhibition rate (%) | Maximum improvement over prior art templates (%) |
|---|---|---|---|---|
| B262 | Modification templates of the present disclosure | B262-DV29P | 15.39 | 7.14 |
| | | B262-DV26P | 26.01 | 17.76 |
| | | B262-DV27P | 22.86 | 14.61 |
| | | B262-DV28P | 26.18 | 17.93 |
| | | B262-DV32P | 24.24 | 15.99 |
| | | B262-DV34P | 19.67 | 11.42 |
| | Prior art modification templates | B262-DV30P | 9.48 | NA |
| | | B262-DV31P | 10.25 | NA |
| | | B262-DV21P | 9.63 | NA |
| | | B262-DV22P | 11.13 | NA |

When the unmodified sequence B262 was modified using the templates DV26P-29P, DV32P, and DV34P of the present disclosure, the inhibition rates for both HBsAg and HBeAg were significantly increased compared to those modified with prior art templates. For example, when modified with the template DV26P, the sequence B261-DV26P showed increases in HBsAg and HBeAg inhibition rates by 28.99% and 17.93%, at a maximum. Detailed results are shown in Table 32 and Table 33.

(12) Unmodified Sequence B264

TABLE 34

HBsAg inhibition rates of unmodified sequence B264 modified with templates

| unmodified sequence code | Modification template | Sequence code | HBsAg inhibition rate (%) | Maximum improvement over prior art templates (%) |
|---|---|---|---|---|
| B264 | Modification templates of the present disclosure | B264-DV29P | 54.01 | 35.22 |
| | | B264-DV26P | 43.99 | 25.20 |
| | | B264-DV27P | 33.85 | 15.06 |
| | | B264-DV28P | 34.32 | 15.53 |
| | | B264-DV32P | 40.74 | 21.95 |
| | | B264-DV34P | 49.25 | 30.46 |
| | Prior art modification templates | B264-DV30P | 27.46 | NA |
| | | B264-DV31P | 22.99 | NA |
| | | B264-DV21P | 21.70 | NA |
| | | B264-DV22P | 18.79 | NA |

TABLE 35

HBeAg inhibition rates of unmodified sequence B264 modified with templates

| unmodified sequence code | Modification template | Sequence code | HBeAg inhibition rate (%) | Maximum improvement over prior art templates (%) |
|---|---|---|---|---|
| B264 | Modification templates of the present disclosure | B264-DV29P | 14.65 | 13.12 |
| | | B264-DV26P | 13.12 | 11.59 |
| | | B264-DV27P | 9.23 | 7.70 |
| | | B264-DV28P | 9.96 | 8.43 |
| | | B264-DV32P | 11.31 | 9.78 |
| | | B264-DV34P | 14.16 | 12.63 |
| | Prior art modification templates | B264-DV30P | 6.40 | NA |
| | | B264-DV31P | 5.44 | NA |
| | | B264-DV21P | 3.19 | NA |
| | | B264-DV22P | 1.53 | NA |

When the unmodified sequence B264 was modified using the templates DV26P-29P, DV32P, and DV34P of the present disclosure, the inhibition rates for both HBsAg and HBeAg were significantly increased compared to those modified with prior art templates. For example, when modified with the template DV29P, the sequence B264-DV29P showed increases in HBsAg and HBeAg inhibition rates by 35.22% and 13.12%, respectively. Detailed results are shown in Table 34 and Table 35.

From this, the following conclusions can be drawn:

1) For the unmodified sequences A261, B262, and B264, modification with the templates DV26P-29P, DV32P and DV34P of the present disclosure resulted in significantly superior inhibition of both HBsAg and HBeAg compared to those modified with prior art templates. For the unmodified sequence A261, modification with the template DV26P of the present disclosure resulted in the highest inhibition rates for HBsAg and modification with the template DV27P resulted in the highest inhibition rates for HBeAg, significantly outperforming the prior art templates. For the unmodified sequence B262, modification with the template DV28P of the present disclosure resulted in the highest inhibition rates for both HBsAg and HBeAg, significantly outperforming the prior art templates. For the unmodified sequence B264, modification with the template DV29P of the present disclosure resulted in the highest inhibition rates for both HBsAg and HBeAg, significantly outperforming the prior art templates.

2) The activity of the same siRNA sequence can vary significantly when modified with different templates. For example, the unmodified sequence B264 modified with the template DV27P of the present disclosure showed an decrease in HBsAg inhibition rate by 20.16% compared to modification with the template DV29P, indicating a significant drop.

(3) siRNA sequences with similar sequences can exhibit vastly different levels of activity. For example, the DV29P-modified sequence A261-DV29P showed a 40.21% higher HBsAg inhibition rate compared to B262-DV29P, and a 30.46% higher inhibition rate compared to B264-DV29P.

4) From this, it can be concluded that despite having similar unmodified sequences, the sensitivity to different modification templates varies. For example, the unmodified sequence B262 modified with the template DV28P of the present disclosure achieved the highest inhibition rates for both HBsAg and HBeAg, while the unmodified sequence B264 achieved the highest inhibition rates for HBsAg and HBeAg when modified with the template DV29P.

(13) Unmodified Sequence A416

TABLE 36

HBsAg inhibition rates of unmodified sequence A416 modified with templates

| unmodified sequence code | Modification template | Sequence code | HBsAg inhibition rate (%) | Maximum improvement over prior art templates (%) |
|---|---|---|---|---|
| A416 | Modification templates of the present disclosure | A416-DV29P | 79.71 | 22.02 |
| | | B416-DV26P | 75.18 | 17.49 |
| | | B416-DV27P | 86.88 | 29.19 |
| | | B416-DV28P | 74.34 | 16.65 |
| | | B416-DV32P | 70.09 | 12.40 |
| | | B416-DV34P | 79.83 | 22.14 |
| | Prior art modification templates | B416-DV30P | 58.66 | NA |
| | | B416-DV31P | 62.28 | NA |
| | | B416-DV21P | 57.69 | NA |
| | | B416-DV22P | 59.74 | NA |

TABLE 37

HBeAg inhibition rates of unmodified sequence A416 modified with templates

| unmodified sequence code | Modification template | Sequence code | HBeAg inhibition rate (%) | Maximum improvement over prior art templates (%) |
|---|---|---|---|---|
| A416 | Modification templates of the present disclosure | A416-DV29P | 43.72 | 25.31 |
| | | B416-DV26P | 40.96 | 22.55 |
| | | B416-DV27P | 52.24 | 33.83 |
| | | B416-DV28P | 40.23 | 21.82 |
| | | B416-DV32P | 34.14 | 15.73 |
| | | B416-DV34P | 40.65 | 22.24 |
| | Prior art modification templates | B416-DV30P | 18.80 | NA |
| | | B416-DV31P | 23.19 | NA |
| | | B416-DV21P | 18.41 | NA |
| | | B416-DV22P | 21.15 | NA |

When the unmodified sequence A416 was modified using the templates DV26P-29P, DV32P, and DV34P of the present disclosure, the inhibition rates for both HBsAg and HBeAg were significantly increased compared to those modified with prior art templates. For example, when modified with DV27P, the sequence showed increases in HBsAg and HBeAg inhibition rates by 29.19% and 33.83%, respectively. Detailed results are shown in Table 36 and Table 37.

(14) Unmodified Sequence B416S

TABLE 38

HBsAg inhibition rates of unmodified sequence B416S modified with templates

| unmodified sequence code | Modification template | Sequence code | HBsAg inhibition rate (%) | Maximum improvement over prior art templates (%) |
|---|---|---|---|---|
| B416S | Modification templates of the present disclosure | B416S-DV29P | 7.30 | 0.92 |
| | | B416S-DV26P | 12.43 | 6.05 |
| | | B416S-DV27P | 13.62 | 7.24 |
| | | B416S-DV28P | 10.78 | 4.40 |
| | | B416S-DV32P | 13.64 | 7.26 |
| | | B416S-DV34P | 8.56 | 2.18 |
| | Prior art modification templates | B416S-DV30P | 6.38 | NA |
| | | B416S-DV31P | 6.98 | NA |
| | | B416S-DV21P | 8.85 | NA |
| | | B416S-DV22P | 10.44 | NA |

TABLE 39

HBeAg inhibition rates of unmodified sequence B416S modified with templates

| unmodified sequence code | Modification template | Sequence code | HBeAg inhibition rate (%) | Maximum improvement over prior art templates (%) |
|---|---|---|---|---|
| B416S | Modification templates of the present disclosure | B416S-DV29P | 10.64 | 13.39 |
| | | B416S-DV26P | 16.35 | 19.10 |
| | | B416S-DV27P | 22.62 | 25.37 |
| | | B416S-DV28P | 7.76 | 10.51 |
| | | B416S-DV32P | 4.86 | 7.61 |
| | | B416S-DV34P | 1.11 | 3.86 |
| | Prior art modification templates | B416S-DV30P | −2.75 | NA |
| | | B416S-DV31P | 6.43 | NA |
| | | B416S-DV21P | 10.16 | NA |
| | | B416S-DV22P | 10.67 | NA |

The unmodified sequence B416S was modified using the templates DV26P-29P, DV32P, and DV34P of the present disclosure. Compared with those modified with prior art templates, the above sequences showed relatively low inhibition rates for both HBsAg and HBeAg, which were less than 25%. Detailed results are shown in Table 38 and Table 39.

(15) Unmodified Sequence B418S

TABLE 40

HBsAg inhibition rates of unmodified sequence B418S modified with templates

| unmodified sequence code | Modification template | Sequence code | HBsAg inhibition rate (%) | Maximum improvement over prior art templates (%) |
|---|---|---|---|---|
| B418S | Modification templates of the present disclosure | B418S-DV29P | 82.05 | 20.31 |
| | | B418S-DV26P | 87.20 | 25.46 |
| | | B418S-DV27P | 78.23 | 16.49 |
| | | B418S-DV28P | 84.79 | 23.05 |
| | | B418S-DV32P | 84.77 | 23.03 |
| | | B418S-DV34P | 87.36 | 25.62 |
| | Prior art modification templates | B418S-DV30P | 61.74 | NA |
| | | B418S-DV31P | 74.66 | NA |
| | | B418S-DV21P | 71.43 | NA |
| | | B418S-DV22P | 73.83 | NA |

TABLE 41

HBeAg inhibition rates of unmodified sequence B418S modified with templates

| unmodified sequence code | Modification template | Sequence code | HBeAg inhibition rate (%) | Maximum improvement over prior art templates (%) |
|---|---|---|---|---|
| B418S | Modification templates of the present disclosure | B418S-DV29P | 45.48 | 17.47 |
| | | B418S-DV26P | 53.70 | 25.69 |
| | | B418S-DV27P | 40.78 | 12.77 |
| | | B418S-DV28P | 51.16 | 23.15 |
| | | B418S-DV32P | 49.10 | 21.09 |
| | | B418S-DV34P | 54.92 | 26.91 |
| | Prior art modification templates | B418S-DV30P | 28.01 | NA |
| | | B418S-DV31P | 35.26 | NA |
| | | B418S-DV21P | 32.32 | NA |
| | | B418S-DV22P | 33.63 | NA |

When the unmodified sequence B418S was modified using the templates DV26P-29P, DV32P, and DV34P of the present disclosure, the inhibition rates for both HBsAg and HBeAg were significantly increased compared to those modified with prior art templates. For example, when modified with the template DV34P, the sequence showed increases in HBsAg and HBeAg inhibition rates by 25.62% and 26.91%, respectively. Detailed results are shown in Table 40 and Table 41.

From this, the following conclusions can be drawn:

1) The unmodified sequences A416 and B418S, when modified with the templates DV26P-29P, DV32P and DV34P of the present disclosure, showed significantly superior inhibition of both HBsAg and HBeAg compared to those modified with prior art templates. For the unmodified sequence A416, modification with the template DV27P of the present disclosure resulted in the highest inhibition rates for both HBsAg and HBeAg. For the unmodified sequence B418S, modification with DV34P resulted in the highest inhibition rates for both HBsAg and HBeAg. For the unmodified sequence B416S, modification with DV26P-28P, DV32P, DV34P, and the sequence modified by modified templates of prior art resulted in relatively low inhibition rates for both HBsAg and HBeAg, which were less than 25%.

2) The activity of the same siRNA sequence can vary significantly when modified with different templates. For example, the unmodified sequence A416 modified with the template DV27P of the present disclosure showed an decrease in HBsAg inhibition rate by 16.79% compared to the template DV32P.

(3) siRNA sequences with similar sequences can exhibit vastly different levels of activity. For example, the DV29P-modified sequence A416-DV29P showed a 72.41% higher HBsAg inhibition rate compared to B416S-DV29P.

4) From this, it can be concluded that despite having similar unmodified sequences, the sensitivity to different modification templates varies. For example, the unmodified sequence A416 modified with the template DV27P of the present disclosure achieved the highest inhibition rates for both HBsAg and HBeAg, while the unmodified sequence B418S achieved the highest inhibition rates for HBsAg and HBeAg when modified with the template DV34P.

(ii) IC50 Experiment and Cytotoxicity Results

The top-performing sequences from the single-concentration screening experiment were selected for IC50 experiments, including B207S-DV29P, B207S-DV32P, B1575-DV29P, B1575-DV26P, B1575-DV27P, B1572-DV27P, B1573-DV29P, B1550-DV27P, B261-DV26P, B416-DV27P, B418S-DV34P, and the positive control APC-VIR, totaling 12 sequences. The IC50 concentrations of each sequence were determined.

TABLE 42

IC50 experimental results for modified sequences

| Sequence code | IC50 (nM) HBsAg | IC50 (nM) HBeAg | $CC_{50}$ (nM) | Cell viability at 10 nM (%) |
|---|---|---|---|---|
| B1572-DV27P | 0.0538 | 0.2073 | >10 | 111.87 |
| B1550-DV27P | 0.0570 | 0.2143 | >10 | 109.67 |
| B207S-DV32P | 0.0572 | 0.7848 | >10 | 111.97 |
| B1575-DV26P | 0.0629 | 0.2923 | >10 | 95.97 |
| B1575-DV27P | 0.0664 | 0.3226 | >10 | 91.47 |
| B261-DV26P | 0.0859 | 3.5030 | >10 | 98.89 |
| B1575-DV29P | 0.1134 | 0.4648 | >10 | 94.89 |
| B1573-DV29P | 0.1191 | 0.5772 | >10 | 92.92 |
| B418S-DV34P | 0.1198 | 0.4498 | >10 | 100.53 |
| B207S-DV29P | 0.1292 | 0.8175 | >10 | 106.15 |
| B416-DV27P | 0.1321 | 0.4353 | >10 | 99.97 |
| APC-VIR | 0.3362 | 1.8900 | >10 | 106.05 |

The IC50 experimental results showed that the IC50 values of these 11 sequences for HBsAg ranged from 0.05 nM to 0.15 nM, all of which were lower than the IC50 value of the positive control sequence (0.3362 nM), demonstrating superior inhibitory effects compared to the positive control. For example, the IC50 values of sequences B1572-DV27P, B1550-DV27P, and B207S-DV32P for HBsAg were 0.0538 nM, 0.0570 nM, and 0.0572 nM, respectively, indicating that these sequences effectively inhibit HBsAg expression at low concentrations. Except for the sequence B261-DV26P, the IC50 values of the remaining 10 sequences for HBeAg ranged from 0.2 nM to 0.85 nM, all of which were lower than the IC50 value of the positive control sequence (1.89 nM), demonstrating superior inhibitory effects compared to the positive control. For example, the IC50 values of sequences B1550-DV27P, B1572-DV27P, and B1575-DV26P for HBeAg were 0.2073 nM, 0.2143 nM, and 0.2923 nM, respectively, indicating that these sequences effectively inhibit HBeAg expression at low concentrations. Experimental results are shown in Table 42.

The cytotoxicity results showed that all 11 sequences exhibited cell viability greater than 90% at the highest tested concentration of 10 nM, indicating no significant cytotoxicity and suggesting a wide concentration range for selection. Detailed results are shown in Table 42.

Example 5: Comparison of HBV Gene Inhibition with Prior Art Sequences

This example compares the inhibition efficiency of HBV genes between: unmodified sequences disclosed in prior art that are identical or similar to the disclosed unmodified sequences B207S, B1575, B1550, B1572, A416, B1573, and B418S; and sequences modified with prior art disclosed templates (DV30P, DV31P, DV21P, DV22P) and modified with the templates of the present disclosure (DV25P, DV26P, DV27P, DV28P, DV29P, DV32P, DV33P, and DV34P).

1. Experimental Materials

Test Samples:

(1) Sequences Disclosed in Prior Art, as Listed in Table 43.

TABLE 43

| Sequences disclosed in prior art | | | | | | |
|---|---|---|---|---|---|---|
| Sequence code | Position | Sense strand | Sequence ID No | Antisense strand | Sequence ID No | Source |
| P206 | 206-226 | CGGGGUUUUUCUUGUUGACAA | 19 | UUGUCAACAAGAAAAACCCCG | 76 | WO2023093896A1 |
| B207S | 207-226 | GGGGUUUUUCUUGUUGACAA | 1 | UUGUCAACAAGAAAAACCCCGC | 8 | Sequences designed in the present disclosure |
| P413 | 413-433 | UCCUGCUGCUAUGCCUCAUCU | 27 | AUGAGGCAUAGCAGCAGGATT | 77 | US20060287266A1 |
| A416 | 416-436 | UGCUGCUAUGCCUCAUCUUCU | 7 | AGAAGAUGAGGCAUAGCAGCAGG | 14 | Sequences designed in the present disclosure |
| P1551 | 1551-1571 | CCGUCUGUGCCUUCUCAUCUA | 44 | UAGAUGAGAAGGCACAGACGGGG | 78 | CN108064294B |
| A1550 | 1550-1570 | CCCGUCUGUGCCUUCUCAUCU | 2 | AGAUGAGAAGGCACAGACGGGGA | 9 | Sequences designed in the present disclosure |
| APC | 1579-1597 | GUGUGCACUUCGCUUCACA | 45 | UGUGAAGCGAAGUGCACACUU | 79 | CN114828859A |
| B1575 | 1575-1595 | GACCGUGUGCACUUCGCUUCA | 4 | UGAAGCGAAGUGCACACGGUCCG | 11 | Sequences designed in the present disclosure |
| A1573 | 1573-1593 | CGGACCGUGUGCACUUCGCUU | 5 | AAGCGAAGUGCACACGGUCCGGC | 12 | Sequences designed in the present disclosure |
| B1572 | 1572-1592 | CCGGACCGUGUGCACUUCGCU | 3 | AGCGAAGUGCACACGGUCCGGCA | 10 | Sequences designed in the present disclosure |

Note:
The sequences disclosed in the above patent applications are all unmodified RNA sequences.

(2) The siRNA sequences modified with the templates DV25P, DV26P, DV27P, DV28P, DV29P, DV32P, DV33P, DV34P, DV30P, DV31P, DV21P, and DV22P, as described in Example 4, along with their corresponding unmodified sequences.

Cell line: HepG2.2.15 cells.

Vehicle reagents: Sterile nuclease-free water and Gibco™ Opti-MEM.

2. Experimental Methods

Referring to Example 2, the concentration for the single-concentration screening experiment was set at 0.3 nM.

3. Experimental Results

The experimental results showed that the unmodified sequences disclosed in this study—B207S, A1550, B1572, B1575, A1573, B418S, and A416-exhibited significantly higher inhibition rates for both HBsAg and HBeAg compared to the similar sequences P206, P413, P1551, and APC from prior art. After template modification, the inhibition rates were further significantly improved.

The comparison of inhibition rates for HBsAg and HBeAg between sequences which have similar sequences to the present disclosure disclosed in prior art and those disclosed in the present disclosure are shown in Table 44 and Table 45.

From Table 43, it can be observed that, compared to the prior art sequence P206, the disclosed sequence B207S is shifted backward by 1 base and shortened by 1 base. Compared with P206, B207S showed an increase in inhibition rates for HBsAg and HBeAg by 15.57% and 11.69%, respectively. When B207S was further modified with the disclosed templates, the inhibition efficiency was further enhanced. For example, when modified with DV32P, the sequence B207S-DV32P showed an increase in inhibition rates for HBsAg and HBeAg by 28.92% and 20.55%, respectively, significantly outperforming the prior art modification templates (DV30P, DV31P, DV21P, and DV22P).

Compared to the prior art sequence P413, the disclosed sequence A416 is shifted backward by 3 bases. Compared with P413, A416 showed an increase in inhibition rates for HBsAg and HBeAg by 5.95% and 7.42%, respectively.

When A416 was further modified with the disclosed templates, the inhibition efficiency was further enhanced. For example, when modified with DV27P, the sequence B416-DV27P showed an increase in inhibition rates for HBsAg and HBeAg by 24.16% and 21.26%, respectively, significantly outperforming the prior art modification templates (DV30P, DV31P, DV21P, and DV22P).

Compared to the prior art sequence P1551, the disclosed sequence A1550 is shifted forward by 1 base. Compared to P1551, A1550 showed an increase in inhibition rates for HBsAg and HBeAg by 7.98% and 9.03%, respectively. When A1550 was further modified with the disclosed templates, the inhibition efficiency was further enhanced. For example, when modified with DV27P, the sequence B1550-DV27P showed an increase in inhibition rates for HBsAg and HBeAg by 23.96% and 26.06%, respectively, significantly outperforming the prior art modification templates (DV30P, DV31P, DV21P, and DV22P).

Compared to the prior art sequence APC, the disclosed sequences B1575, B1573, and B1572 are shifted forward by 4, 6, and 7 bases, respectively, and all are extended by 2 bases in length. Compared to APC, B1575, B1573, and B1572 showed an increase in inhibition rates for HBsAg by 13.46%, 10.80%, and 9.94%, respectively. When modified with the disclosed templates, the inhibition efficiency was further improved. For example, the sequence B1575-DV29P showed the most significant improvement, with an increase in HBsAg inhibition rate by 29.28% and an increase in HBeAg inhibition rate by 24.25%. The sequence B1575-DV26P showed an increase in HBsAg inhibition rate by 27.18% and an increase in HBeAg inhibition rate by 16.55%, significantly outperforming the prior art modification templates (DV30P, DV31P, DV21P, and DV22P).

TABLE 44

Comparison of HBsAg inhibition rates between prior art disclosed sequences and sequences of the present disclosure

| Prior art disclosed sequences | | Sequences (unmodified) of the present disclosure | | | Sequences modified with templates of the present disclosure | | |
|---|---|---|---|---|---|---|---|
| Sequence code | HBsAg inhibition rate (%) | Sequence code | HBsAg inhibition rate (%) | Improvement over prior art (%) | Sequence code | HBsAg inhibition rate (%) | Improvement over unmodified sequences of the present disclosure (%) |
| P206 | 53.77 | B207S | 69.34 | 15.57 | B207S-DV25P | 94.78 | 25.44 |
| | | | | | B207S-DV26P | 86.62 | 17.28 |
| | | | | | B207S-DV27P | 95.06 | 25.72 |
| | | | | | B207S-DV28P | 86.52 | 17.18 |
| | | | | | B207S-DV29P | 98.65 | 29.31 |
| | | | | | B207S-DV32P | 98.26 | 28.92 |
| | | | | | B207S-DV33P | 88.32 | 18.98 |
| | | | | | B207S-DV34P | 86.63 | 17.29 |
| | | | | | B207S-DV30P | 74.85 | 5.51 |
| | | | | | B207S-DV31P | 81.37 | 12.03 |
| | | | | | B207S-DV21P | 69.82 | 0.48 |
| | | | | | B207S-DV22P | 71.01 | 1.67 |
| P413 | 52.04 | A416 | 57.99 | 5.95 | B416-DV26P | 75.33 | 17.34 |
| | | | | | B416-DV27P | 82.15 | 24.16 |
| | | | | | B416-DV28P | 75.07 | 17.08 |
| | | | | | A416-DV29P | 75.70 | 17.71 |
| | | | | | B416-DV32P | 70.66 | 12.67 |
| | | | | | B416-DV34P | 81.69 | 23.70 |
| | | | | | B416-DV30P | 56.21 | −1.78 |
| | | | | | B416-DV31P | 69.48 | 11.49 |
| | | | | | B416-DV21P | 58.99 | 1.00 |
| | | | | | B416-DV22P | 60.95 | 2.96 |
| P1551 | 57.31 | A1550 | 65.29 | 7.98 | B1550-DV26P | 88.52 | 23.23 |
| | | | | | B1550-DV27P | 89.25 | 23.96 |
| | | | | | B1550-DV28P | 77.80 | 12.51 |
| | | | | | A1550-DV29P | 86.74 | 21.45 |
| | | | | | B1550-DV32P | 77.73 | 12.44 |
| | | | | | B1550-DV33P | 79.47 | 14.18 |
| | | | | | B1550-DV34P | 85.48 | 20.19 |
| | | | | | B1550-DV25P | 85.81 | 20.52 |
| | | | | | B1550-DV30P | 68.12 | 2.83 |
| | | | | | B1550-DV31P | 63.80 | −1.49 |
| | | | | | B1550-DV21P | 64.15 | −1.14 |
| | | | | | B1550-DV22P | 68.90 | 3.61 |
| APC | 50.43 | B1575 | 63.89 | 13.46 | B1575-DV26P | 91.07 | 27.18 |
| | | | | | B1575-DV27P | 88.25 | 24.36 |
| | | | | | B1575-DV28P | 72.83 | 8.94 |
| | | | | | B1575-DV29P | 93.17 | 29.28 |
| | | | | | B1575-DV32P | 87.32 | 23.43 |
| | | | | | B1575-DV34P | 82.93 | 19.04 |

TABLE 44-continued

Comparison of HBsAg inhibition rates between prior art disclosed sequences and sequences of the present disclosure

| Prior art disclosed sequences | | Sequences (unmodified) of the present disclosure | | | Sequences modified with templates of the present disclosure | | |
|---|---|---|---|---|---|---|---|
| Sequence code | HBsAg inhibition rate (%) | Sequence code | HBsAg inhibition rate (%) | Improvement over prior art (%) | Sequence code | HBsAg inhibition rate (%) | Improvement over unmodified sequences of the present disclosure (%) |
| | | | | | B1575-DV30P | 59.71 | −4.18 |
| | | | | | B1575-DV31P | 72.68 | 8.79 |
| | | | | | B1575-DV21P | 65.74 | 1.85 |
| | | | | | B1575-DV22P | 64.72 | 0.83 |
| | | A1573 | 61.23 | 10.80 | B1573-DV26P | 81.64 | 20.41 |
| | | | | | B1573-DV27P | 84.86 | 23.63 |
| | | | | | B1573-DV28P | 83.80 | 22.57 |
| | | | | | A1573-DV29P | 85.81 | 24.58 |
| | | | | | B1573-DV32P | 84.80 | 23.57 |
| | | | | | B1573-DV34P | 80.26 | 19.03 |
| | | | | | B1573-DV30P | 63.12 | 1.89 |
| | | | | | B1573-DV31P | 63.19 | 1.96 |
| | | | | | B1573-DV21P | 65.81 | 4.58 |
| | | | | | B1573-DV22P | 66.99 | 5.76 |
| | | B1572 | 60.37 | 9.94 | B1572-DV26P | 86.77 | 26.40 |
| | | | | | B1572-DV27P | 89.82 | 29.45 |
| | | | | | B1572-DV28P | 83.89 | 23.52 |
| | | | | | B1572-DV29P | 84.17 | 23.80 |
| | | | | | B1572-DV32P | 81.39 | 21.02 |
| | | | | | B1572-DV34P | 83.96 | 23.59 |
| | | | | | B1572-DV30P | 66.54 | 6.17 |
| | | | | | B1572-DV31P | 65.84 | 5.47 |
| | | | | | B1572-DV21P | 69.99 | 9.62 |
| | | | | | B1572-DV22P | 71.53 | 11.16 |

TABLE 45

Comparison of HBeAg inhibition rates between prior art disclosed sequences and sequences of the present disclosure

| Prior art disclosed sequences | | Sequences (unmodified) of the present disclosure | | | Sequences modified with templates of the present disclosure | | |
|---|---|---|---|---|---|---|---|
| Sequence code | HBsAg inhibition rate (%) | Sequence code | HBsAg inhibition rate (%) | Improvement over prior art (%) | Sequence code | HBeAg inhibition rate (%) | Improvement over sequences of the present disclosure (%) |
| P206 | 27.19 | B207S | 38.88 | 11.69 | B207S-DV25P | 41.66 | 2.78 |
| | | | | | B207S-DV26P | 47.89 | 9.01 |
| | | | | | B207S-DV27P | 46.54 | 7.66 |
| | | | | | B207S-DV28P | 47.63 | 8.75 |
| | | | | | B207S-DV29P | 58.42 | 19.54 |
| | | | | | B207S-DV32P | 59.43 | 20.55 |
| | | | | | B207S-DV33P | 47.63 | 8.75 |
| | | | | | B207S-DV34P | 38.69 | −0.19 |
| | | | | | B207S-DV30P | 34.25 | −4.63 |
| | | | | | B207S-DV31P | 40.94 | 2.06 |
| | | | | | B207S-DV21P | 30.74 | −8.14 |
| | | | | | B207S-DV22P | 31.84 | −7.04 |
| P413 | 16.93 | A416 | 24.35 | 7.42 | B416-DV26P | 41.99 | 17.64 |
| | | | | | B416-DV27P | 45.61 | 21.26 |
| | | | | | B416-DV28P | 42.71 | 18.36 |
| | | | | | A416-DV29P | 43.65 | 19.30 |
| | | | | | B416-DV32P | 37.06 | 12.71 |
| | | | | | B416-DV34P | 39.47 | 15.12 |
| | | | | | B416-DV30P | 20.97 | −3.38 |
| | | | | | B416-DV31P | 25.68 | 1.33 |
| | | | | | B416-DV21P | 20.85 | −3.50 |
| | | | | | B416-DV22P | 23.80 | −0.55 |

TABLE 45-continued

Comparison of HBeAg inhibition rates between prior art disclosed sequences and sequences of the present disclosure

| Prior art disclosed sequences | | Sequences (unmodified) of the present disclosure | | | Sequences modified with templates of the present disclosure | | |
|---|---|---|---|---|---|---|---|
| Sequence code | HBsAg inhibition rate (%) | Sequence code | HBsAg inhibition rate (%) | Improvement over prior art (%) | Sequence code | HBeAg inhibition rate (%) | Improvement over sequences of the present disclosure (%) |
| P1551 | 18.05 | A1550 | 27.08 | 9.03 | B1550-DV26P | 48.71 | 21.63 |
| | | | | | B1550-DV27P | 53.14 | 26.06 |
| | | | | | B1550-DV28P | 38.04 | 10.96 |
| | | | | | A1550-DV29P | 45.43 | 18.35 |
| | | | | | B1550-DV32P | 41.80 | 14.72 |
| | | | | | B1550-DV33P | 45.16 | 18.08 |
| | | | | | B1550-DV34P | 46.20 | 19.12 |
| | | | | | B1550-DV25P | 46.53 | 19.45 |
| | | | | | B1550-DV30P | 31.30 | 4.22 |
| | | | | | B1550-DV31P | 30.55 | 3.47 |
| | | | | | B1550-DV21P | 30.09 | 3.01 |
| | | | | | B1550-DV22P | 33.10 | 6.02 |
| APC | 29.92 | B1575 | 44.16 | 14.24 | B1575-DV26P | 60.71 | 16.55 |
| | | | | | B1575-DV27P | 55.11 | 10.95 |
| | | | | | B1575-DV28P | 39.88 | −4.28 |
| | | | | | B1575-DV29P | 68.41 | 24.25 |
| | | | | | B1575-DV32P | 53.41 | 9.25 |
| | | | | | B1575-DV34P | 52.81 | 8.65 |
| | | | | | B1575-DV30P | 41.39 | −2.77 |
| | | | | | B1575-DV31P | 49.74 | 5.58 |
| | | | | | B1575-DV21P | 43.74 | −0.42 |
| | | | | | B1575-DV22P | 42.29 | −1.87 |
| | | A1573 | 29.76 | −0.16 | B1573-DV26P | 51.92 | 22.16 |
| | | | | | B1573-DV27P | 52.11 | 22.35 |
| | | | | | B1573-DV28P | 48.66 | 18.90 |
| | | | | | A1573-DV29P | 53.09 | 23.33 |
| | | | | | B1573-DV32P | 58.01 | 28.25 |
| | | | | | B1573-DV34P | 41.95 | 12.19 |
| | | | | | B1573-DV30P | 22.65 | −7.11 |
| | | | | | B1573-DV31P | 32.32 | 2.56 |
| | | | | | B1573-DV21P | 30.80 | 1.04 |
| | | | | | B1573-DV22P | 39.54 | 9.78 |
| | | B1572 | 35.63 | 5.71 | B1572-DV26P | 60.82 | 25.19 |
| | | | | | B1572-DV27P | 61.66 | 26.03 |
| | | | | | B1572-DV28P | 53.00 | 17.37 |
| | | | | | B1572-DV29P | 55.21 | 19.58 |
| | | | | | B1572-DV32P | 39.45 | 3.82 |
| | | | | | B1572-DV34P | 48.64 | 13.01 |
| | | | | | B1572-DV30P | 35.69 | 0.06 |
| | | | | | B1572-DV31P | 29.89 | −5.74 |
| | | | | | B1572-DV21P | 35.69 | 0.06 |
| | | | | | B1572-DV22P | 37.37 | 1.74 |

Example 6: Inhibition of HBV and Off-Target Genes by Sequences with Specific Anti-Off-Target Design In practical applications of siRNA, there are numerous instances where non-target mRNAs with only partial complementarity to the guide strand (antisense strand) are also suppressed. Studies by Alnylam Pharmaceuticals have shown that the hepatotoxicity of GalNAc-conjugated siRNA is primarily attributed to off-target effects caused by the suppression of incorrect targets through a miRNA-like recognition mechanism.

To address this issue, thermolabile nucleotide modifications, such as glycol nucleic acid (GNA), unlocked nucleic acid (UNA), or DNA, can be introduced at positions 6 and 7 of the seed region of the antisense strand. These modifications disrupt the seed region of the antisense strand, thereby reducing the binding of siRNA to non-target mRNAs through seed region recognition and significantly mitigating off-target effects and hepatotoxicity. In its latest fifth-generation template design, Alnylam Pharmaceuticals has adopted the approach of placing a GNA modification at position 7 of the siRNA antisense strand to reduce off-target effects.

In this example, the unmodified sequences B207S, B1575, A1550, B1572, A1573, A261, A416, and B418S were used to study off-target and anti-off-target effects. To evaluate the off-target effects of each sequence, qPCR was used to compare the inhibition efficiency of target genes and off-target genes in cellular experiments.

To reduce off-target effects, sequences with potential off-target activity, such as B418S-DV34P and B416-DV27P, were modified with DNA or GNA at positions 6 and 7 of the antisense strand. These anti-off-target modifications were compared with unmodified sequences in terms of activity and off-target effects.

1. Experimental Materials

Test samples: sequences modified with templates listed in Table 46 and corresponding sequences with anti-off-target designs (synthesis methods refer to Example 1). In the sequence codes, d67B indicates that the sequence is modified with the d67B3 anti-off-target design, d7B indicates modification with the d7B anti-off-target design, and + indicates modification with GNA for anti-off-target purposes.

Cell line: HepG2.2.15 cells.

Vehicle reagents: Sterile nuclease-free water and Gibco™ Opti-IVEM™.

Plating: HepG2.2.15 cells were plated in DMEM/F12 medium containing 10% fetal bovine serum (FBS), 1% L-glutamine, 1% non-essential amino acids, and 1% penicillin-streptomycin.

2.2 Cell Transfection

Preparation of transfection reagent: Lipofectamine RNAiMAX and Opti-MEM were mixed in a 2:98 ratio and vortexed thoroughly.

TABLE 46

Template-modified and anti-off-target designed sequences

| Unmodified sequence code | Sequence code | Sense strand sequence 5'-3' | Sequence ID No | Unmodified sequence ID No | Antisense strand sequence 5'-3' | Sequence ID No | Unmodified sequence ID No |
|---|---|---|---|---|---|---|---|
| B418S | B418S-DV34P | Cms-Ums-Gm-Cm-Um-Af-Um-Gf-Cm-Cf-Um-Cm-Am-Um-Cm-Uf-Um-Cm-Um-Um | 106 | 6 | AmsEVP-Afs-Gf-Am-Am-Gf-Am-Um-Gm-Am-Gm-Gm-Cm-Af-Um-Af-Gm-Cm-Am-Gms-Cms-Am | 216 | 13 |
| B418S | C418S-DV34 Pd67B | Cms-Ums-Gm-Cm-Um-Af-Um-Gf-Cm-Cf-Um-Cm-Am-dT-dC-Uf-Um-Cm-Um-Um | 305 | 6 | AmsEVP-Afs-Gf-Am-Am-dG-dA-Um-Gm-Am-Gm-Gm-Cm-Af-Um-Af-Gm-Cm-Am-Gms-Cms-Am | 320 | 13 |
| B418S | C418S-DV34 Pd7B | Cms-Ums-Gm-Cm-Um-Af-Um-Gf-Cm-Cf-Um-Cm-Am-dT-Cm-Uf-Um-Cm-Um-Um | 306 | 6 | AmsEVP-Afs-Gf-Am-Am-Gf-dA-Um-Gm-Am-Gm-Gm-Cm-Af-Um-Af-Gm-Cm-Am-Gms-Cms-Am | 321 | 13 |
| B418S | C418S-DV34P+ | Cms-Ums-Gm-Cm-Um-Af-Um-Gf-Cm-Cf-Um-Cm-Am-Um-Cm-Uf-Um-Cm-Um-Um | 307 | 6 | AmsEVP-Afs-Gf-Am-Am-G(gna)-Am-Um-Gm-Am-Gm-Gm-Cm-Af-Um-Af-Gm-Cm-Am-Gms-Cms-Am | 322 | 13 |
| A416 | B416-DV27P | Ums-Gms-Cm-Um-Gm-Cm-Uf-Am-Uf-Gf-Cf-Cm-Um-Cm-Am-Um-Cf-Um-Um-Cm-Um | 112 | 7 | AmsEVP-Gfs-Am-Af-Gf-Af-Um-Gm-Am-Gm-Gm-Cm-Am-Uf-Am-Gf-Cm-Am-Gm-Cm-Ams-Gms-Gm | 219 | 14 |
| A416 | C416-DV27 Pd67B | Ums-Gms-Cm-Um-Gm-Cm-Uf-Am-Uf-Gf-Cf-Cm-Um-Cm-dA-dT-Cf-Um-Um-Cm-Um | 302 | 7 | AmsEVP-Gfs-Am-Af-Gf-dA-dT-Gm-Am-Gm-Gm-Cm-Am-Uf-Am-Gf-Cm-Am-Gm-Cm-Ams-Gms-Gm | 317 | 14 |
| A416 | C416-DV27 Pd7B | Ums-Gms-Cm-Um-Gm-Cm-Uf-Am-Uf-Gf-Cf-Cm-Um-Cm-dA-Um-Cf-Um-Um-Cm-Um | 303 | 7 | AmsEVP-Gfs-Am-Af-Gf-Af-dT-Gm-Am-Gm-Gm-Cm-Am-Uf-Am-Gf-Cm-Am-Gm-Cm-Ams-Gms-Gm | 318 | 14 |
| A416 | C416-DV27P+ | Ums-Gms-Cm-Um-Gm-Cm-Uf-Am-Uf-Gf-Cf-Cm-Um-Cm-Am-Um-Cf-Um-Um-Cm-Um | 304 | 7 | AmsEVP-Gfs-Am-Af-Gf-A(gna)-Um-Gm-Am-Gm-Gm-Cm-Am-Uf-Am-Gf-Cm-Am-Gm-Cm-Ams-Gms-Gm | 319 | 14 |

2. Experimental Methods

The inhibition of HBV and off-target genes in HepG2.2.15 cells by the test samples was detected using qRT-PCR.

2.1 Cell Culture

Subculture: HepG2.2.15 cells were subcultured in DMEM/F12 medium containing 10% fetal bovine serum, 370 pig/mL Geneticin, 1% L-glutamine, 1% non-essential amino acids, and 1% penicillin-streptomycin. The cells were maintained in a cell incubator at 37° C. with 5% $CO_2$ and subcultured every three days. For subculturing, the cells were detached using 0.25% trypsin, centrifuged at 800 rpm for 3 minutes, and the supernatant was discarded. Fresh medium was then added for further subculture.

Preparation of transfection complex: 30 μL of siRNA solution diluted in Opti-MEM was combined with 30 μL of the transfection mixture at a 1:1 (v/v) ratio, vortexed, and incubated at room temperature for 15 minutes to form the transfection complex.

Preparation of control transfection reagent: 15 μL of the prepared transfection mixture was added to 15 μL of Opti-MEM. The mixture was vortexed and then incubated at room temperature for 15 minutes.

The prepared transfection complexes were added to a 96-well cell culture plate (15 μL per well, with three replicates per sequence), resulting in final siRNA concentrations of 0.065 nM, 0.14 nM, and 0.28 nM per well. For each siRNA, three concentrations were tested, with three replicates per concentration. 135 μL of cell suspension (containing $2.25\times10^4$ cells) was added to each well. After mixing using the cross-mixing method, the plate was placed in a 37° C., 5% $CO_2$ cell incubator for incubation.

2.3 RNA Extraction and Reverse Transcription

After 48 hours of transfection, the medium was removed, and the cells were collected for RNA extraction. Total RNA was extracted using the RNeasy® 96 Kit (QIAGEN-74182) according to the manufacturer's instructions. Subsequently, RNA was reverse-transcribed into cDNA using the HiScript III RT SuperMix for qPCR (Vazyme) following the manufacturer's protocol.

2.4 RT-qPCR

The cDNA of HBV and off-target genes was detected by qPCR, with GAPDH cDNA used as an internal control for parallel detection. A total of 8 IL of prepared qPCR reaction mix and 2 IL of sample cDNA were added to each well of a 384-well plate. The SYBR qPCR reaction program was as follows: incubation at 50° C. for 2 min, heating at 95° C. for 2 min, followed by cycling at 95° C. for 5 s and 60° C. for 30 s for a total of 40 cycles. Finally, the melting curve was analyzed by heating at 95° C. for 15 s, 60° C. for 1 min, and 95° C. for 15 s.

2.5 Data Analysis

The RNA expression levels of the target genes in the samples were calculated based on the CT values using the ΔΔACT relative quantification method. The relative expression of the target genes was expressed as 2-ΔΔACT The calculation formulas are as follows:

$$\Delta CT = \text{Average } CT \text{ value of the target gene} - \text{Average } CT \text{ value of } GAPDH;$$

$$\Delta\Delta CT = \Delta CT(\text{experimental group}) - \Delta CT(\text{transfection control group});$$

$$\text{Relative } mRNA \text{ expression of the target gene} = 2^{-\Delta\Delta CT};$$

$$\text{Gene expression inhibition rate (\%)} = (1 - mRNA \text{ expression level of the sample}/ mRNA \text{ expression level of the transfection control group}) \times 100\%.$$

3. Experimental Results

The experimental results showed that sequences B207S, B1575, A1550, B1572, A1573, and A261 exhibited no off-target effects. After applying the anti-off-target design, sequences B418S-DV34P and A416-DV27P demonstrated a significant reduction in the inhibition of off-target genes without affecting the inhibition efficiency of the target gene HBV. This indicates that the anti-off-target design does not compromise the inhibitory effect of the disclosed template-modified sequences on the HBV gene but significantly suppresses off-target effects.

(i) qPCR Analysis of Potential Off-Target Effects and Anti-Off-Target Efficacy of Each Sequence (1) The inhibition efficiency of each sequence on the target gene and off-target genes is shown in Table 47. Sequence A416 exhibited a clear concentration-dependent inhibition of the SLCO2B1 gene, with a maximum inhibition rate of 40.05%. Sequence B418S showed a certain concentration-dependent inhibition of the SLC41A2 gene, with a maximum inhibition rate of 24.13%. The inhibition rates of the remaining sequences (B207S, A1550, and A416) on off-target genes were all below 20%, suggesting no off-target effects. Sequences A416 and B418S were associated with a higher number of potential off-target genes, indicating that these sequences may have potential off-target effects.

TABLE 47

Inhibition effects of each sequence on off-target genes and the target gene

| Unmodified sequence code | Sequence code | Gene | IC50 (nM) | Maximum inhibition rate (%) |
|---|---|---|---|---|
| B207S | B207S-DV29P | SEPTIN6 | >30 | <20 |
| | | AAK1 | >30 | <20 |
| | | CCSAP | >30 | <20 |
| | | COX5A | >30 | <20 |
| | | ABCB10 | >30 | <20 |
| | | IRS1 | >30 | <20 |
| | | ELP1 | >30 | <20 |
| | | NUS1 | >30 | <20 |
| | | SUB1 | >30 | <20 |
| | | AFF4 | >30 | <20 |
| | | NDUFA5 | >30 | <20 |
| | | CSNK1D | >30 | <20 |
| | | EXOC1 | >30 | <20 |
| | | HBV | 0.46 | NA |
| A1550 | B1550-DV27P | USP36 | >30 | <20 |
| | | CHMP7 | >30 | <20 |
| | | HBV | 0.84 | NA |
| A416 | B416-DV27P | SLCO2B1 | >30 | 40.05 |
| | | SLC41A2 | >30 | <20 |
| | | HBV | 1.59 | NA |
| B418S | B418S-DV34P | SLC41A2 | >30 | 24.13 |
| | | HBV | 0.27 | NA |

(2) Anti-off-target designs d7B and d67B were applied to sequences A416 and B418S. The inhibition effects of the anti-off-target designed sequences and the non-anti-off-target designed sequences on off-target genes and the target gene are shown in Table 48. Results indicate that after the anti-off-target modification with d7B, the IC50 of sequence C416-DV27Pd7B for the off-target gene SLCO2B1 increased by 5.69-fold, and the maximum inhibition rate decreased by 9.54%. The maximum inhibition rate of sequence C418S-DV34Pd7B for the off-target gene SLC41A2 decreased by 16.91%, significantly outperforming the anti-off-target modifications d67B and GNA. Meanwhile, the IC50 of sequence C418S-DV34Pd7B for the target gene HBV was 0.22 nM, which is comparable to that of the non-anti-off-target modified sequence B418S-DV34P. The maximum inhibition rates for the target gene were both around 81%, indicating that the d7B modification did not affect the inhibitory effect of sequence C418S-DV34Pd7B on the target gene.

TABLE 48

Inhibition effects of anti-off-target modified sequences on off-target genes and the target gene

| Gene | Unmodified sequence code | Sequence code | IC50 (nM) | Maximum inhibition rate (%) |
|---|---|---|---|---|
| SLCO2B1 | A416 | B416-DV27P | 23 | 63.83 |
| | | C416-DV27Pd67B | >150 | 48.72 |
| | | C416-DV27Pd7B | 130.76 | 54.29 |
| | | C416-DV27P+ | >150 | 28.53 |

TABLE 48-continued

Inhibition effects of anti-off-target modified sequences on off-target genes and the target gene

| Gene | Unmodified sequence code | Sequence code | IC50 (nM) | Maximum inhibition rate (%) |
|---|---|---|---|---|
| SLC41A2 | A416 | B416-DV27P | >150 | 1.15 |
| | | C416-DV27Pd67B | >150 | 7.63 |
| | | C416-DV27Pd7B | >150 | 4.41 |
| | | C416-DV27P+ | >150 | 30.64 |
| | B418S | B418S-DV34P | >150 | 17.89 |
| | | C418S-DV34Pd67B | >150 | 16.48 |
| | | C418S-DV34Pd7B | >150 | 0.98 |
| | | C418S-DV34P+ | >150 | 11.81 |
| HBV | A416 | B416-DV27P | 0.79 | 74.67 |
| | | C416-DV27Pd67B | 1.99 | 74.93 |
| | | C416-DV27Pd7B | 3.88 | 70.57 |
| | | C416-DV27P+ | 3.29 | 83.93 |
| | B418S | B418S-DV34P | 0.16 | 81.58 |
| | | C418S-DV34Pd67B | 0.24 | 89.56 |
| | | C418S-DV34Pd7B | 0.22 | 81.84 |
| | | C418S-DV34P+ | 1.4 | 68.55 |

Example 7: Inhibition of HBV in Mice by Sequences Modified with the Templates (High Dose) of the Present Disclosure This example exemplarily selects several sequences, including unmodified sequences B3418S, A416, B1550, 1B207S, B1575, B1572, and A1573. These sequences were modified, for example, using only template modifications or combining template modifications with anti-off-target designs, and all were conjugated with GalNAc ligands. The in vivo efficacy of these RNAi agents at a high dose (e.g., 3 mg/kg) after repeated administration was analyzed using an AAV-HBV mouse model. This mouse model, after infection with a recombinant adeno-associated virus (AAV) carrying a replicable HBV genome, can continuously produce HBV viral particles and HBV antigens for over one year without seroconversion, replicating some immunological features of clinical chronic hepatitis B patients. Therefore, this model is also used to evaluate new immune-based therapies and antiviral treatments. In this example, the AAV-HBV mouse model was used to detect the inhibitory effects of the aforementioned sequences on serum HBsAg, HBeAg, and HBV DNA at different time points, as well as their impact on the reconstruction of adaptive immune function in mice at specific time points.

1. Experimental Materials

Test Compounds:

The sequences listed in Table 49 include sequences with only template modifications and sequences with both template modifications and anti-off-target designs. The 3' end of the sense strand of these sequences is conjugated with the GalNAc ligand G5, with the structural formula as follows:

G5

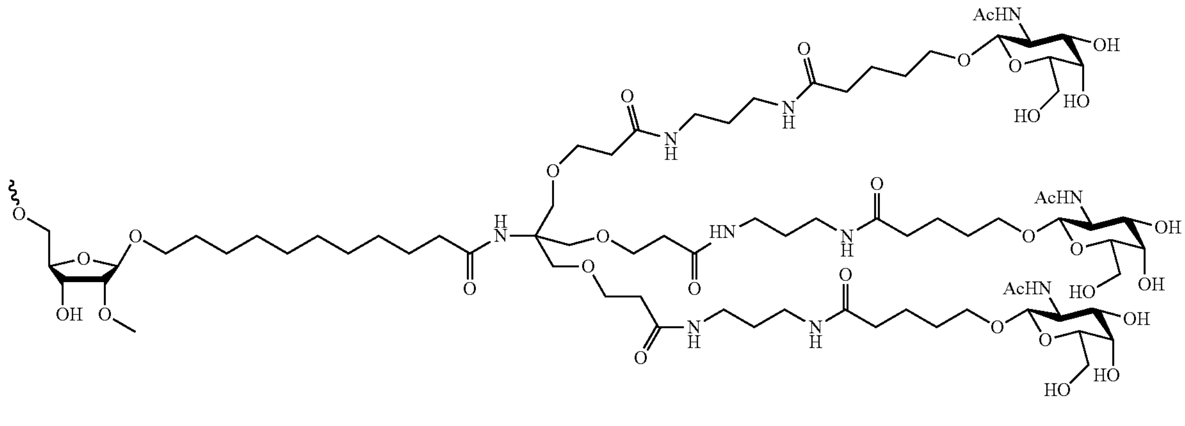

The conjugation method of the oligonucleotide with the ligand G5 refers to the preparation method described in Example 3 of the patent application CN116854754A.

The oligonucleotide and ligand G5 form the conjugate as shown below:

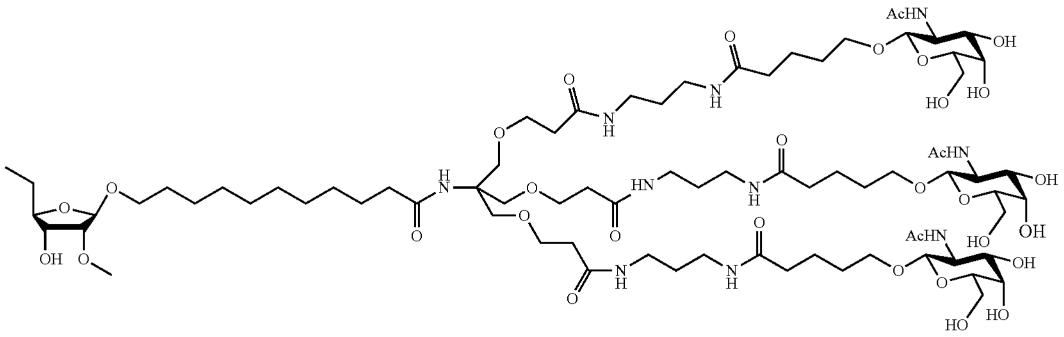

The specific sequences of each sequence are listed in Table 49. In the sequence codes, "G5" indicates that the sequence is conjugated with the GalNAc ligand G5, and "GL" indicates that the sequence is conjugated with the GalNAc ligand L96.

The structural formula of L96 is as follows:

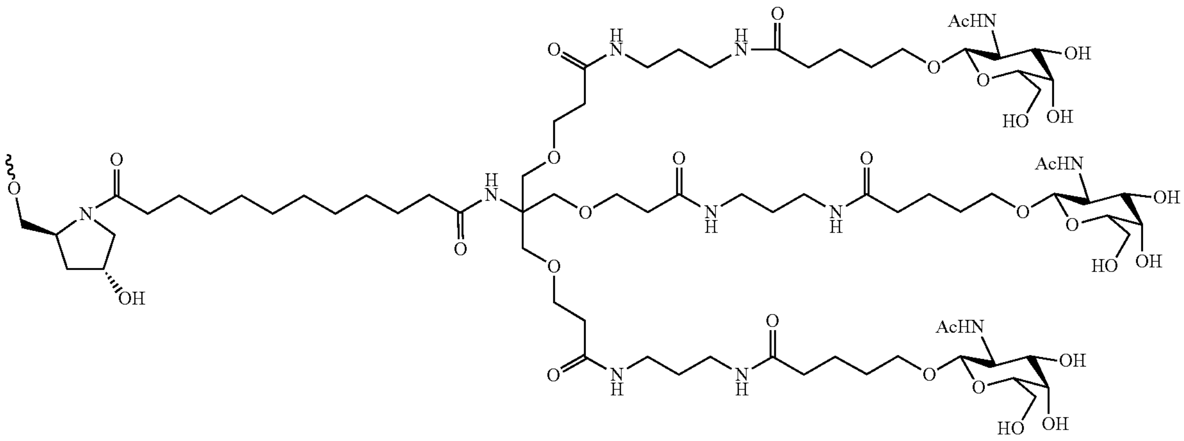

TABLE 49 siRNA sequences used in animal experiments

| Unmodified sequence code | Sequence code | Sense strand sequence 5'-3' | Sequence ID No | Unmodified sequence ID No | Antisense strand sequence 5'-3' | Sequence ID No | Unmodified sequence ID No |
|---|---|---|---|---|---|---|---|
| B207S | C207S-DV29PG5 | Gms-Gms-Gm-Gm-Um-Uf-Um-Uf-Um-Cf-Um-Um-Gm-Um-Um-Gf-Am-Cm-Am-Am-G5 | 326 | 1 | UmsEVP-Ufs-Gm-Uf-Cf-Af-Am-Cm-Am-Am-Gm-Am-Am-Af-Am-Af-Cm-Cm-Cm-Cms-Gms-Cm | 179 | 8 |
| B207S | C207S-DV32PG5 | Gms-Gms-Gm-Gm-Um-Uf-Um-Uf-Um-Cf-Um-Um-Gm-Um-Um-Gf-Am-Cm-Am-Am-G5 | 329 | 1 | UmsEVP-Ufs-Gm-Um-Cf-Af-Am-Cm-Am-Am-Gm-Am-Am-Af-Am-Af-Cm-Cm-Cm-Cms-Gms-Cm | 181 | 8 |
| A1550 | C1550-DV27PG5 | Cms-Cms-Cm-Gm-Um-Cm-Uf-Gm-Uf-Gf-Cf-Cm-Um-Um-Cm-Um-Cf-Am-Um-Cm-Um-G5 | 332 | 2 | AmsEVP-Gfs-Am-Uf-Gf-Af-Gm-Am-Am-Gm-Gm-Cm-Am-Cf-Am-Gf-Am-Cm-Gm-Gm-Gms-Gms-Am | 187 | 9 |
| B1572 | C1572- | Cms-Cms-Gm-Gm-Am-Cm-Cf-Gm-Uf-Gf-Uf-Gm- | 335 | 3 | AmsEVP-Gfs-Cm-Gf-Af-Af-Gm-Um-Gm-Cm-Am-Cm- | 195 | 10 |

TABLE 49-continued siRNA sequences used in animal experiments

| Unmodified sequence code | Sequence code | Sense strand sequence 5'-3' | Sequence ID No | Unmodified sequence ID No | Antisense strand sequence 5'-3' | Sequence ID No | Unmodified sequence ID No |
|---|---|---|---|---|---|---|---|
| | DV27 PG5 | Cm-Am-Cm-Um-Uf-Cm-Gm-Cm-Um-G5 | | | Am-Cf-Gm-Gf-Um-Cm-Cm-Gm-Gms-Cms-Am | | |
| B1575 | C1575-DV27 PG5 | Gms-Ams-Cm-Cm-Gm-Um-Gf-Um-Gf-Cf-Af-Cm-Um-Um-Cm-Gm-Cf-Um-Um-Cm-Am-G5 | 338 | 4 | UmsEVP-Gfs-Am-Af-Gf-Cf-Gm-Am-Am-Gm-Um-Gm-Cm-Af-Cm-Af-Cm-Gm-Gm-Um-Cms-Cms-Gm | 201 | 11 |
| B1575 | C1575-DV29 PG5 | Gms-Ams-Cm-Cm-Gm-Um-Gf-Um-Gf-Cm-Af-Cm-Um-Um-Cm-Gm-Cf-Um-Um-Cm-Am-G5 | 341 | 4 | UmsEVP-Gfs-Am-Af-Gf-Cf-Gm-Am-Am-Gm-Um-Gm-Cm-Af-Cm-Af-Cm-Gm-Gm-Um-Cms-Cms-Gm | 201 | 11 |
| A1573 | C1573-DV29 PG5 | Cms-Gms-Gm-Am-Cm-Cm-Gf-Um-Gf-Um-Gf-Cm-Am-Cm-Um-Um-Cf-Gm-Cm-Um-Um-G5 | 344 | 5 | AmsEVP-Afs-Gm-Cf-Gf-Af-Am-Gm-Um-Gm-Cm-Am-Cm-Af-Cm-Gf-Gm-Um-Cm-Cm-Gms-Gms-Cm | 207 | 12 |
| A416 | C416-DV27 Pd7B G5 | Ums-Gms-Cm-Um-Gm-Cm-Uf-Am-Uf-Gf-Cf-Cm-Um-Cm-dA-Um-Cf-Um-Um-Cm-Um-G5 | 347 | 7 | AmsEVP-Gfs-Am-Af-Gf-Af-dT-Gm-Am-Gm-Gm-Cm-Am-Uf-Am-Gf-Cm-Am-Gm-Cm-Ams-Gms-Gm | 318 | 14 |
| B418S | C418 S-DV34 Pd7BG5 | Cms-Ums-Gm-Cm-Um-Af-Um-Gf-Cm-Cf-Um-Cm-Am-dT-Cm-Uf-Um-Cm-Um-Um-G5 | 350 | 6 | AmsEVP-Afs-Gf-Am-Am-Gf-dA-Um-Gm-Am-Gm-Gm-Cm-Af-Um-Af-Gm-Cm-Am-Gms-Cms-Am | 321 | 13 |
| APC | VIR-2218-GL | Gms-Ums-Gm-Um-Gf-Cm-Af-Cf-Uf-Um-Cm-Gm-Cm-Um-Um-Cm-Am-Cm-Am-GL | 353 | 45 | Ums-Gfs-Um-Gm-Am-A(gna)-Gm-Cf-Gf-Am-Am-Gm-Um-Gf-Cm-Af-Cm-Am-Cms-Ums-Um | 294 | 79 |
| ANC | CNC-G5 | Gms-Gms-Um-Cm-Um-Cm-Uf-Um-Cf-Um-Af-Um-Cm-Gm-Am-Um-Cm-Um-Um-Am-Um-G5 | 354 | 46 | AmsEVP-Ufs-Am-Af-Gf-Af-Um-Cm-Gm-Am-Um-Am-Gm-Af-Am-Gf-Am-Gm-Am-Cm-Cms-Cms-Am | 295 | 80 |

Preparation of Test Compounds:

Solvent: PBS buffer

Preparation conditions: Sterile environment

Labeling Method: Prepared dosing formulations are labeled with tags indicating the project number, name, concentration, quantity, preparation date, preparer, and storage conditions on the outer packaging.

Storage conditions: Prepared immediately before use; remaining samples are stored at −80° C.

Experimental Animal Information:

Species/Strain: AAV-HBV mice

Grade: SPF (Specific Pathogen-Free)

Gender: Male

Quantity: 100

Age: 7 weeks

Weight: 19-24 g

Source: Guangdong Zhiyuan Biomedical Technology Co., Ltd.

Production license number: SCXK (Yue) 2021-0057

Institutional Animal Care and Use Committee (IACUC):

After receipt, the experimental animals were feeded at GuangZhou Jennio Biotech Co., Ltd., with the license number: JENNIO (Jinbin) 2019-0002. This project has been reviewed and approved by the Institutional Animal Care and Use Committee (IACUC) of GuangZhou Jennio Biotech Co., Ltd., with the IACUC approval number JENNIO-IACUC-2024-A005. The experimental procedures were strictly conducted in accordance with IACUC requirements to ensure animal welfare.

Feeding and Management:

Feeding conditions: After receipt, the experimental animals were housed at Guangzhou Jennio Biotech Co., Ltd. The animals were feeded in cages with dimensions of length×width×height=29.0 cm×18.5 cm×13.0 cm. The environmental conditions were set to a temperature range of 20-26° C. and a humidity range of 40%-70%, with automatic lighting on a 12-hour light/dark cycle.

The feeding environment conditions adhered to the National Standard of the People's Republic of China GB14925-2010.

Animals were provided with ad libitum access to food and water. The feed consisted of irradiated sterilized maintenance diet for experimental mice, supplied by Jiangsu Collaborative Medical Biotechnology Co., Ltd., with the production license number Su Feed Certificate (2019) 01008. The nutritional composition of the feed was tested in accordance with the National Standard of the People's Republic of China GB14924.3-2010, and the pollutant content was tested in accordance with the National Standard of the People's Republic of China GB14924.2-2001. The feed supplier provided a test report for each batch. Drinking water was reverse osmosis water, provided in water bottles. The drinking water was tested in accordance with the National Standard of the People's Republic of China GB5750-2006 and sent to a third-party testing agency for annual testing.

The animal bedding consisted of corncob bedding, supplied by Guangzhou Saibainuo Biotechnology Co., Ltd., with the production license number SCXK (Jing) 2019-0004. The pollutant content of the bedding was tested in accordance with the National Standard of the People's Republic of China GB14924.2-2001, and the bedding supplier provided a test report for each batch.

Animal cages and bedding were replaced at least once a week. All cages and bedding were sterilized using a pulse vacuum sterilizer before being introduced into the barrier environment. Animal cage racks were cleaned and disinfected at least once a week.

The animal feeding observation rooms were cleaned and disinfected daily, including shelves, floors, tables, and other surfaces.

The disinfectants used in the barrier environment include: 6.67% benzalkonium bromide solution, 0.5% 84 disinfectant, 75% disinfectant, and 0.08% Bestaquam. These four disinfectants are to be used in rotation and must not be mixed.

2. Experimental Methods 2.1 AAV-HBV Mouse Model Preparation

Definition of experimental timeline: The day of administration of the vehicle or test substance to the animals is defined as Day 0.

One hundred SPF-grade C57BL/6 male mice were acclimatized in a barrier facility for 7 days, with daily observations to confirm their health and absence of abnormalities before model preparation. The mice were injected via the tail vein with rAAV8-1.3HBV (produced by Guangzhou PackGene Biotechnology Co., Ltd.; product name: AAV8HBV-D,ayw, batch number: HBV101-6) at a dose of 1×10^11 GC/100 μL per mouse. After model preparation, blood was collected from the animals at weeks 5 and 6 (D-14 and D-7), followed by centrifugation and plasma collection to measure HBV DNA, HBsAg, and HBeAg levels.

2.2 Animal Grouping and Administration

Definition of experimental timeline: The day of administration of the vehicle or test substance to the animals is defined as Day 0 (DO).

Grouping was performed based on the indicators at week 6 (D-7) of model preparation. Seventy-two successfully modeled animals were selected and randomly divided into 12 groups of 6 mice each according to HBsAg levels. The average HBsAg levels were ensured to be comparable across groups, with no statistically significant differences in HBV DNA and HBeAg levels between groups. Administration began at week 7 (DO) of model preparation, with details on grouping and administration shown in Table 50.

TABLE 50

Group settings and administration details

| Group | Administration regimen | Administra-tion route | Number of animals |
|---|---|---|---|
| siRNA (11 groups) | 3 mg/kg, administered on D 0, D 7, and D 14 | s.c. | 6 mice/group × 11 groups |
| Vehicle control (1 group) | PBS, administered once on D 0, D 7, and D 14 | s.c. | 6 mice/group × 1 group |

Note:
s.c. represents subcutaneous injection.

2.3 Secondary Challenge Experiment

On D60 of administration, 3 mice from the C207S-DV32PG5 group were selected for hydrodynamic tail vein injection with 8 μg of pAAV-HBV 1.2 plasmid (Fenghui Biotech) at an injection volume of 100 μL/g for the challenge. The remaining 3 mice were left untreated. Additionally, 3 mice from a blank control group were subjected to the same challenge procedure as a control.

2.4 Observation and Indicator Monitoring (1) General Observation

During both the model preparation and experimental periods, animals were observed daily, and records were maintained. Observations included: mortality, moribund state, feed and water intake, injuries, feces, appearance and coat condition, mental state, and activity levels.

(2) Body Weight

Acclimatization period: Body weights were recorded upon animal receipt and on the final day of the acclimatization period.

Experimental period: Body weights were recorded weekly during the experimental period. If administration or blood collection was scheduled on the same day, weights were measured prior to the procedure or before euthanasia.

(3) Measurement of Serum HBsAg, HBeAg, HBV DNA, HBsAb, and ALT Levels

Blood collection (200 μL) was performed via the retro-orbital sinus at Week 5 (D-14) and Week 6 (D-7) post-modeling, as well as before administration (D 0) and weekly thereafter. Blood was collected into EDTA-K2 anticoagulant tubes and centrifuged at 1000×g for 10 minutes to obtain plasma. For mice subjected to the secondary challenge, blood collection (200 μL) was performed via the retro-orbital sinus on D60 (challenge day), followed by additional collections on D63, D67, D74, and D81. Plasma was obtained as described above. For analysis, 20 μL of plasma was diluted with 980 μL of PBS, vortexed, and used for measuring HBsAg, HBV DNA, HBeAg, and ALT levels. Additionally, 15 μL of plasma was diluted with 210 μL of PBS, vortexed, and used for measuring HBsAb levels. All processed samples were analyzed by Guangzhou Huayin Medical Testing Center Co., Ltd. Remaining plasma samples were stored at −80° C. for future use.

3. Experimental Results

The experimental results demonstrated that, compared to the vehicle control group and the negative control group, the sequences B207S-DV32P, A1550-DV27P, B1572-DV27P, B1575-DV27P, B207S-DV29P, A1573-DV29P, B1575-DV29P, B418S-DV34Pd7B, and A416-DV27Pd7B, when conjugated with G5, were effectively targeted to the liver and exhibited sustained and significant suppression of plasma HBsAg, HBeAg, and HBV DNA levels.

Among these, the sequences C207S-DV32PG5, C207S-DV29PG5, and C418S-DV34Pd7BG5 demonstrated superior efficacy in reducing HBsAg, HBV DNA, and HBeAg levels, significantly outperforming the positive control sequence VIR-2218-GL. Furthermore, the sequences C207S-DV32PG5 and C207S-DV29PG5 achieved complete seroclearance of HBsAg and HBV DNA in all mice within their respective groups, accompanied by the generation of high levels of antibodies. In the C418S-DV34Pd7BG5 group, 3 out of 6 mice also achieved HBsAg seroclearance, along with the production of high antibody levels.

The results of the secondary challenge experiment showed that the blank control group (mice not previously infected with HBV before D56) exhibited detectable levels of HBsAg, HBeAg, and HBV DNA post-challenge, confirming the effectiveness of the challenge method. In the C207S-DV32PG5 challenge group, HBV DNA levels initially increased post-challenge but subsequently declined to below the detection limit. Concurrently, serum HBsAb levels significantly increased, while HBsAg remained below the detection limit. These results confirm the effectiveness of the challenge and demonstrate that mice treated with this small nucleic acid sequence were protected against reinfection with HBV This evidence proves that HBV-infected mice treated with this small nucleic acid sequence are protected against subsequent HBV viral attacks.

Figure 1B:
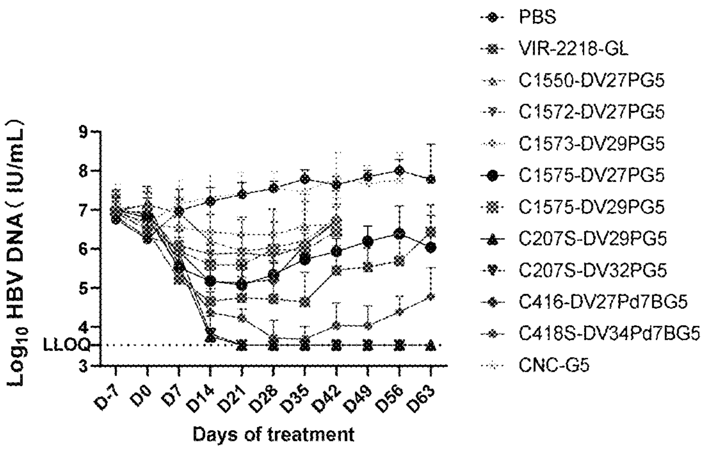
FIG. 1B shows serum HBV DNA levels in AAV-HBV model mice at a dose of 3 mg/kg of the candidate siRNA sequence.
Figure 1C:
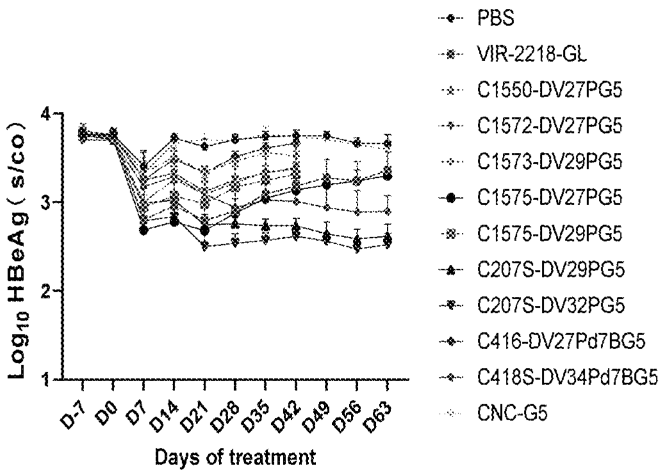
FIG. 1C shows serum HBeAg levels in AAV-HBV model mice at a dose of 3 mg/kg of the candidate siRNA sequence.
Figure 1D:
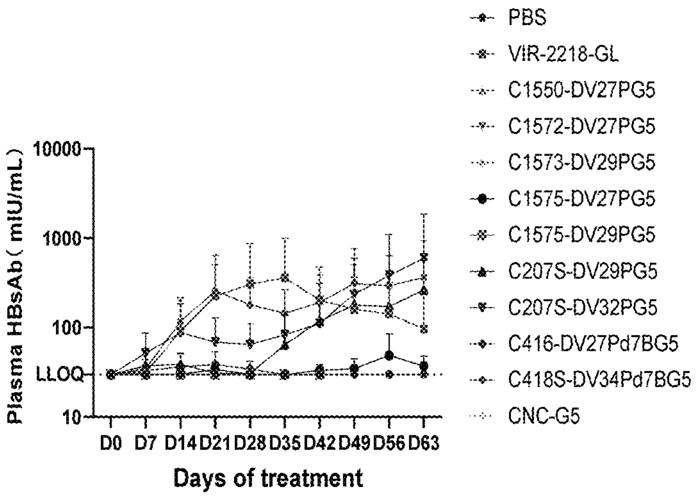
FIG. 1D shows serum HBsAb levels in AAV-HBV model mice at a dose of 3 mg/kg of the candidate siRNA sequence.
Figure 1E:
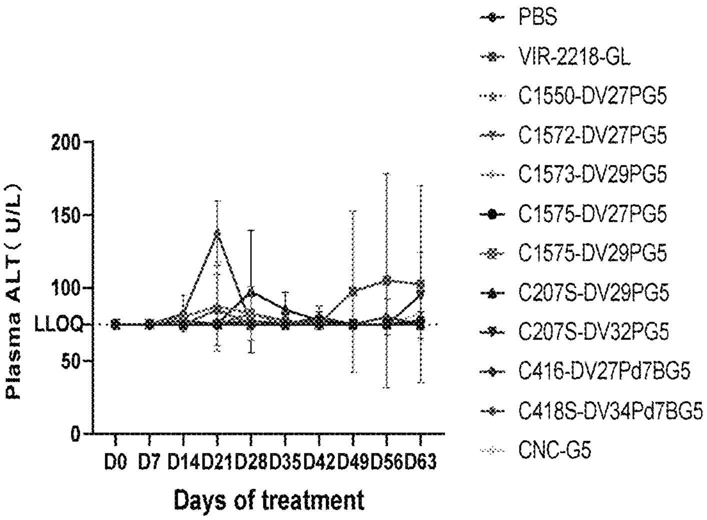
FIG. 1E shows serum ALT levels in AAV-HBV model mice at a dose of 3 mg/kg of the candidate siRNA sequence.
Figure 1F:
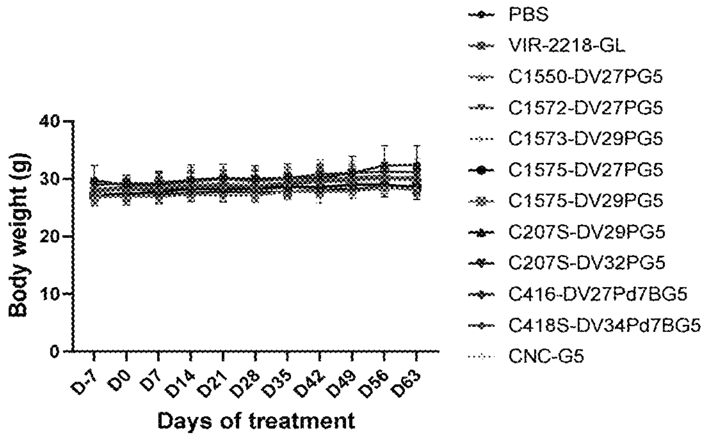
FIG. 1F shows body weight changes in AAV-HBV model mice at a dose of 3 mg/kg of the candidate siRNA sequence.

(i) Temporal Changes in HBsAg, HBeAg, HBV DNA, HBsAb, and ALT Levels in Mice Across Sequence Groups The temporal changes in HBsAg, HBeAg, HBV DNA, HBsAb, ALT, and body weight levels in mice across the groups are shown in Tables 51-59 and FIGS. 1A-1F. The data indicate that the sequences C207S-DV32PG5, C207S-DV29PG5, and C418S-DV34Pd7BG5 exhibited superior efficacy in reducing HBsAg, HBV DNA, and HBeAg levels, significantly outperforming the positive control sequence VIR-2218-GL. Furthermore, the sequences C207S-DV32PG5 and C207S-DV29PG5 achieved complete seroclearance of HBsAg and HBV DNA in all mice within their respective groups, accompanied by the generation of high levels of antibodies. Specifically, the C207S-DV32PG5 group achieved complete seroclearance of HBsAg and HBV DNA in all mice by Day 14 and Day 21 post-administration, respectively, and this effect persisted until the end of the experiment. These results suggest that the mice achieved functional cure. In the C418S-DV34Pd7BG5 group, 3 out of 6 mice also achieved HBsAg seroclearance, along with the production of high antibody levels. These data collectively demonstrate the superior therapeutic efficacy of the sequences C207S-DV32PG5, C207S-DV29PG5, and C418S-DV34Pd7BG5.

TABLE 51

Changes in plasma HBsAg levels in mice across sequence groups

| Unmodified sequence code | Sequence code | Log10 HBsAg (IU/mL) D -7 | D 0 | D 7 | D 14 | D 21 | D 28 | D 35 | D 42 | D 49 | D 56 | D 63 |
|---|---|---|---|---|---|---|---|---|---|---|---|---|
| | PBS | 3.27 ± 0.60 | 3.16 ± 0.50 | 3.71 ± 0.51 | 3.64 ± 0.34 | 3.85 ± 0.35 | 4.08 ± 0.40 | 4.12 ± 0.36 | 3.96 ± 0.48 | 4.17 ± 0.35 | 4.17 ± 0.44 | 4.14 ± 0.51 |
| APC | VIR-2218-GL | 3.49 ± 0.16 | 3.09 ± 0.38 | 1.61 ± 0.17** | 1.01 ± 0.19** | 0.74 ± 0.28** | 1.15 ± 0.23** | 1.26 ± 0.22** | 1.54 ± 0.45** | 1.63 ± 0.25 | 1.75 ± 0.29 | 2.29 ± 0.44 |
| A1550 | C1550-DV27PG5 | 3.49 ± 0.15 | 3.48 ± 0.18 | 2.83 ± 0.21 | 2.38 ± 0.40 | 2.18 ± 0.47 | 2.28 ± 0.48 | 2.51 ± 0.65 | 2.63 ± 0.52 | — | — | — |
| B1572 | C1572-DV27PG5 | 3.50 ± 0.13 | 3.44 ± 0.36 | 2.76 ± 0.54 | 2.39 ± 0.58 | 2.29 ± 0.52 | 2.49 ± 0.50 | 2.58 ± 0.77 | 2.65 ± 0.73 | — | — | — |
| A1573 | C1573-DV29PG5 | 3.50 ± 0.13 | 3.44 ± 0.30 | 2.98 ± 0.56 | 2.64 ± 0.44 | 2.67 ± 0.38 | 2.62 ± 0.35 | 2.76 ± 0.39 | 2.67 ± 0.51 | — | — | — |
| B1575 | C1575-DV27PG5 | 3.49 ± 0.15 | 3.45 ± 0.24 | 1.62 ± 0.51** | 1.24 ± 0.56* | 1.22 ± 0.50* | 1.47 ± 0.61* | 1.71 ± 0.66* | 1.73 ± 0.68* | 2.12 ± 0.43 | 2.07 ± 0.45 | 1.97 ± 0.74 |
| B1575 | C1575-DV29PG5 | 3.50 ± 0.12 | 3.40 ± 0.18 | 2.31 ± 0.29 | 1.76 ± 0.34 | 1.93 ± 0.44 | 2.23 ± 0.36 | 2.29 ± 0.31 | 2.48 ± 0.29 | — | — | — |
| B207S | C207S-DV29PG5 | 3.50 ± 0.11 | 3.69 ± 0.27 | 1.88 ± 0.32* | 0.43 ± 0.08** | 0.41 ± 0.03**## | 0.43 ± 0.08**## | 0.45 ± 0.12**## | 0.45 ± 0.12**## | 0.40 ± 0.00**## | 0.41 ± 0.03**## | 0.40 ± 0.00**## |
| B207S | C207S-DV32PG5 | 3.50 ± 0.13 | 3.35 ± 0.26 | 1.29 ± 0.53** | 0.40 ± 0.00** | 0.40 ± 0.00**## | 0.40 ± 0.00**## | 0.40 ± 0.00**## | 0.40 ± 0.00**## | 0.40 ± 0.00**## | 0.40 ± 0.00**## | / |
| A416 | C416-DV27Pd7 BG5 | 3.47 ± 0.20 | 3.47 ± 0.16 | 1.90 ± 0.30* | 1.52 ± 0.31 | 1.44 ± 0.34 | 1.79 ± 0.31 | 2.08 ± 0.27 | 2.41 ± 0.13 | — | — | — |
| B418S | C418S-DV34Pd7 BG5 | 3.47 ± 0.23 | 3.41 ± 0.26 | 1.27 ± 0.50* | 0.60 ± 0.40** | 0.51 ± 0.27**# | 0.53 ± 0.31**## | 0.49 ± 0.22**## | 0.61 ± 0.45**# | 0.59 ± 0.35**# | 0.70 ± 0.51**# | 0.95 ± 0.69**# |
| ANC | CNC-G5 | 3.47 ± 0.22 | 3.43 ± 0.23 | 3.83 ± 0.21 | 3.66 ± 0.29 | 3.82 ± 0.32 | 3.88 ± 0.20 | 4.02 ± 0.30 | 4.17 ± 0.30 | 4.02 ± 0.35 | 4.04 ± 0.35 | — |

Notes:
"—" indicates that testing was discontinued.
"/" indicates that the C207S-DV32PG5 group was selected for the challenge experiment on D56.
Compared to the PBS group:
* indicates P < 0.05;
** indicates P <0.01.
Compared to the positive control group (VIR-2218-GL):
# indicates P < 0.05;
## indicates P < 0.01.

TABLE 52

Changes in plasma HBV DNA levels in mice across sequence groups

| Un-modified sequence code | Sequence code | Log10 HBV DNA (IU/mL) D -7 | D 0 | D 7 | D 14 | D 21 | D 28 | D 35 | D 42 | D 49 | D 56 | D 63 |
|---|---|---|---|---|---|---|---|---|---|---|---|---|
| | PBS | 6.76 ± 0.75 | 6.25 ± 0.61 | 6.98 ± 0.54 | 7.22 ± 0.35 | 7.40 ± 0.30 | 7.55 ± 0.17 | 7.79 ± 0.24 | 7.64 ± 0.11 | 7.84 ± 0.16 | 8.01 ± 0.28 | 7.78 ± 0.90 |
| APC | VIR-2218-GL | 6.93 ± 0.30 | 6.47 ± 0.63 | 5.22 ± 0.36** | 4.66 ± 0.33** | 4.75 ± 0.53** | 4.72 ± 0.69* | 4.64 ± 0.76** | 5.45 ± 0.64* | 5.54 ± 0.48 | 5.69 ± 0.69 | 6.44 ± 0.69 |
| A1550 | C1550-DV27PG5 | 7.01 ± 0.47 | 7.12 ± 0.33 | 6.92 ± 0.41 | 6.20 ± 0.67 | 5.94 ± 0.80 | 6.04 ± 0.99 | 6.21 ± 1.00 | 6.79 ± 0.69 | — | — | — |
| B1572 | C1572-DV27PG5 | 6.83 ± 0.50 | 6.30 ± 0.78 | 6.10 ± 1.16 | 5.86 ± 1.03 | 5.90 ± 0.92 | 5.82 ± 1.19 | 6.09 ± 1.31 | 6.69 ± 1.16 | — | — | — |
| A1573 | C1573-DV29PG5 | 7.14 ± 0.22 | 6.63 ± 0.78 | 6.56 ± 0.74 | 6.43 ± 0.69 | 6.37 ± 0.38 | 6.37 ± 0.32 | 6.59 ± 0.4 | 6.63 ± 0.67 | — | — | — |
| B1575 | C1575-DV27PG5 | 6.98 ± 0.39 | 6.81 ± 0.50 | 5.53 ± 0.44** | 5.18 ± 0.49 | 5.08 ± 0.51* | 5.34 ± 0.30 | 5.73 ± 0.42* | 5.93 ± 0.33 | 6.19 ± 0.40 | 6.39 ± 0.71 | 6.04 ± 0.81 |
| B1575 | C1575-DV29PG5 | 6.94 ± 0.29 | 6.65 ± 0.27 | 5.96 ± 0.53* | 5.59 ± 0.55 | 5.59 ± 0.75 | 5.99 ± 0.70 | 5.96 ± 0.43 | 6.46 ± 0.61 | — | — | — |
| B207S | C207S-DV29PG5 | 6.96 ± 0.34 | 7.14 ± 0.46 | 5.61 ± 0.56** | 3.76 ± 0.19** | 3.54 ± 0.00**## | 3.54 ± 0.00**## | 3.54 ± 0.00**## | 3.54 ± 0.00**## | 3.54 ± 0.00**## | 3.54 ± 0.00**## | 3.54= ± 0.00**## |
| B207S | C207S-DV32PG5 | 6.96 ± 0.39 | 6.65 ± 0.50 | 5.92 ± 0.38* | 3.84 ± 0.45** | 3.54 ± 0.00**## | 3.54 ± 0.00**## | 3.54 ± 0.00**## | 3.54 ± 0.00**## | 3.54 ± 0.00**## | 3.54 ± 0.00**## | / |
| A416 | C416-DV27Pd7BG5 | 6.99 ± 0.40 | 6.90 ± 0.40 | 5.94 ± 0.51* | 5.16 ± 0.39 | 5.14 ± 0.59* | 5.21 ± 0.49* | 6.10 ± 0.39 | 6.73 ± 0.42 | — | — | — |
| B418S | C418S-DV34Pd7BG5 | 6.94 ± 0.52 | 6.95 ± 0.50 | 5.47 ± 0.38** | 4.38 ± 0.52** | 4.23 ± 0.24** | 3.72 ± 0.44**# | 3.70 ± 0.32** | 4.04 ± 0.59** | 4.03 ± 0.52* | 4.39 ± 0.41 | 4.78 ± 0.74* |
| ANC | CNC-G5 | 6.76 ± 0.89 | 6.65 ± 0.90 | 7.14 ± 0.63 | 7.33 ± 0.56 | 7.41 ± 0.54 | 7.53 ± 0.44 | 7.48 ± 0.51 | 7.79 ± 0.67 | 7.66 ± 0.47 | 7.77 ± 0.70 | / |

Notes:
"-" indicates that testing was discontinued.
"/" indicates that the C207S-DV32PG5 group was selected for the challenge experiment on D56.
Compared to the PBS group:
* indicates P < 0.05; ** indicates P <0.01.
Compared to the positive control group (VIR-2218-GL):
# indicates P < 0.05; ## indicates P <0.01.

TABLE 53

Changes in plasma HBeAg levels in mice across sequence groups

| Unmodified sequence code | Sequence code | Log10 HBeAg (S/CO) D -7 | D 0 | D 7 | D 14 | D 21 | D 28 | D 35 | D 42 | D 49 | D 56 | D 63 |
|---|---|---|---|---|---|---|---|---|---|---|---|---|
| / | PBS | 3.76 ± 0.06 | 3.76 ± 0.06 | 3.40 ± 0.17 | 3.72 ± 0.05 | 3.63 ± 0.08 | 3.70 ± 0.06 | 3.74 ± 0.05 | 3.75 ± 0.06 | 3.75 ± 0.04 | 3.66 ± 0.06 | 3.66 ± 0.10 |
| APC | VIR-2218-GL | 3.80 ± 0.08 | 3.76 ± 0.05 | 2.80 ± 0.28** | 2.96 ± 0.27** | 2.79 ± 0.25** | 2.90 ± 0.24** | 3.09 ± 0.26* | 3.18 ± 0.22* | 3.27 ± 0.20** | 3.24 ± 0.22* | 3.36 ± 0.20 |
| A1550 | C1550-DV27PG5 | 3.77 ± 0.06 | 3.72 ± 0.09 | 3.00 ± 0.31 | 3.26 ± 0.19 | 3.09 ± 0.18** | 3.22 ± 0.19 | 3.34 ± 0.18 | 3.37 ± 0.17 | — | — | — |
| B1572 | C1572-DV27PG5 | 3.74 ± 0.08 | 3.75 ± 0.06 | 3.25 ± 0.31 | 3.33 ± 0.28 | 3.12 ± 0.26* | 3.25 ± 0.26 | 3.33 ± 0.26 | 3.39 ± 0.27 | — | — | — |
| A1573 | C1573-DV29PG5 | 3.78 ± 0.04 | 3.75 ± 0.09 | 3.33 ± 0.18 | 3.51 ± 0.07 | 3.34 ± 0.07** | 3.46 ± 0.05 | 3.56 ± 0.03 | 3.52 ± 0.06 | — | — | — |

TABLE 53-continued

Changes in plasma HBeAg levels in mice across sequence groups

| Unmodified sequence code | Sequence code | Log10 HBeAg (S/CO) D -7 | D 0 | D 7 | D 14 | D 21 | D 28 | D 35 | D 42 | D 49 | D 56 | D 63 |
|---|---|---|---|---|---|---|---|---|---|---|---|---|
| B1575 | C1575-DV27PG5 | 3.77 ± 0.05 | 3.71 ± 0.05 | 2.69 ± 0.33** | 2.78 ± 0.26** | 2.68 ± 0.14** | 2.87 ± 0.17** | 3.04 ± 0.17** | 3.14 ± 0.14** | 3.20 ± 0.10** | 3.24 ± 0.12** | 3.30 ± 0.07 |
| B1575 | C1575-DV29PG5 | 3.76 ± 0.07 | 3.73 ± 0.04 | 2.95 ± 0.23 | 3.07 ± 0.26** | 2.98 ± 0.24** | 3.17 ± 0.20 | 3.25 ± 0.17 | 3.32 ± 0.13 | — | — | — |
| B207S | C207S-DV29PG5 | 3.75 ± 0.03 | 3.71 ± 0.09 | 2.99 ± 0.16 | 3.02 ± 0.07** | 2.75 ± 0.12** | 2.76 ± 0.10** | 2.73 ± 0.08**## | 2.73 ± 0.09**## | 2.64 ± 0.13**## | 2.59 ± 0.11**## | 2.61 ± 0.14**## |
| B207S | C207S-DV32PG5 | 3.75 ± 0.03 | 3.75 ± 0.05 | 2.79 ± 0.23** | 2.83 ± 0.11*** | 2.50 ± 0.19**# | 2.54 ± 0.11**## | 2.57 ± 0.09**## | 2.61 ± 0.10**## | 2.56 ± 0.09**## | 2.47 ± 0.09**## | / |
| A416 | C416-DV27Pd7BG5 | 3.75 ± 0.05 | 3.77 ± 0.06 | 3.25 ± 0.14 | 3.49 ± 0.09 | 3.33 ± 0.06** | 3.51 ± 0.06 | 3.61 ± 0.06 | 3.67 ± 0.04 | — | — | — |
| B418S | C418S-DV34Pd7BG5 | 3.70 ± 0.10 | 3.70 ± 0.09 | 3.17 ± 0.18 | 3.29 ± 0.11 | 3.09 ± 0.15** | 2.94 ± 0.22** | 3.02 ± 0.22** | 3.01 ± 0.23** | 2.94 ± 0.24**# | 2.89 ± 0.24**## | 2.90 ± 0.18**## |
| ANC | CNC-G5 | 3.76 ± 0.07 | 3.71 ± 0.07 | 3.32 ± 0.14 | 3.66 ± 0.06 | 3.70 ± 0.06 | 3.69 ± 0.05 | 3.76 ± 0.09 | 3.74 ± 0.08 | 3.71 ± 0.08 | 3.64 ± 0.06 | / |

Notes:
"-" indicates that testing was discontinued.
"/" indicates that the C207S-DV32PG5 group was selected for the challenge experiment on D56.
Compared to the PBS group:
* indicates P < 0.05; ** indicates P <0.01.
Compared to the positive control group (VIR-2218-GL):
# indicates P < 0.05; ## indicates P < 0.01.

TABLE 54

Changes in the number of mice with HBsAg clearance across sequence groups

| Unmodified sequence code | Sequence code | Number of mice with HBsAg clearance D 7 | D 14 | D 21 | D 28 | D 35 | D 42 | D 49 | D 56 | D 63 |
|---|---|---|---|---|---|---|---|---|---|---|
| B418S | C418S-DV34Pd7BG5 | 0/6 | 4/6 | 5/6 | 5/6 | 5/6 | 4/6 | 4/6 | 4/6 | 3/6 |
| B207S | C207S-DV32PG5 | 0/6 | 6/6 | 6/6 | 6/6 | 6/6 | 6/6 | 6/6 | 6/6 | 6/6 |
| B1575 | C1575-DV27PG5 | 0/6 | 0/6 | 0/6 | 0/6 | 0/6 | 0/6 | 0/6 | 0/6 | 0/6 |
| B207S | C207S-DV29PG5 | 0/6 | 5/6 | 5/6 | 5/6 | 5/6 | 5/6 | 6/6 | 5/6 | 6/6 |
| APC | VIR-2218-GL | 0/6 | 0/6 | 0/6 | 0/6 | 0/6 | 0/6 | 0/6 | 0/6 | 0/6 |
| A416 | C416-DV27Pd7BG5 | 0/6 | 0/6 | 0/6 | 0/6 | 0/6 | 0/6 | NA | NA | NA |
| B1575 | C1575-DV29PG5 | 0/6 | 0/6 | 0/6 | 0/6 | 0/6 | 0/6 | NA | NA | NA |
| B1572 | C1572-DV27PG5 | 0/6 | 0/6 | 0/6 | 0/6 | 0/6 | 0/6 | NA | NA | NA |
| A1550 | C1550-DV27PG5 | 0/6 | 0/6 | 0/6 | 0/6 | 0/6 | 0/6 | NA | NA | NA |
| A1573 | C1573-DV29PG5 | 0/6 | 0/6 | 0/6 | 0/6 | 0/6 | 0/6 | NA | NA | NA |
| ANC | CNC-G5 | 0/6 | 0/6 | 0/6 | 0/6 | 0/6 | 0/6 | 0/6 | 0/6 | 0/6 |
| | PBS | 0/6 | 0/6 | 0/6 | 0/6 | 0/6 | 0/6 | 0/6 | 0/6 | 0/6 |

TABLE 55

Changes in the number of mice with HBV DNA clearance across sequence groups

| Unmodified sequence code | Sequence code | Number of mice with HBV DNA clearance D 7 | D 14 | D 21 | D 28 | D 35 | D 42 | D 49 | D 56 | D 63 |
|---|---|---|---|---|---|---|---|---|---|---|
| B418S | C418S-DV34Pd7BG5 | 0/6 | 0/6 | 0/6 | 5/6 | 4/6 | 2/6 | 0/6 | 0/6 | 0/6 |
| B207S | C207S-DV32PG5 | 0/6 | 3/6 | 6/6 | 6/6 | 6/6 | 6/6 | 6/6 | 6/6 | 2/6 |
| B1575 | C1575-DV27PG5 | 0/6 | 0/6 | 0/6 | 0/6 | 0/6 | 0/6 | 0/6 | 0/6 | 0/6 |
| B207S | C207S-DV29PG5 | 0/6 | 1/6 | 6/6 | 6/6 | 6/6 | 6/6 | 6/6 | 6/6 | 6/6 |

TABLE 55-continued

Changes in the number of mice with HBV DNA clearance across sequence groups

| Unmodified sequence code | Sequence code | Number of mice with HBV DNA clearance | | | | | | | | |
|---|---|---|---|---|---|---|---|---|---|---|
| | | D 7 | D 14 | D 21 | D 28 | D 35 | D 42 | D 49 | D 56 | D 63 |
| APC | VIR-2218-GL | 0/6 | 0/6 | 0/6 | 1/6 | 1/6 | 0/6 | 0/6 | 0/6 | 0/6 |
| A416 | C416-DV27Pd7BG5 | 0/6 | 0/6 | 0/6 | 0/6 | 0/6 | 0/6 | NA | NA | NA |
| B1575 | C1575-DV29PG5 | 0/6 | 0/6 | 0/6 | 0/6 | 0/6 | 0/6 | NA | NA | NA |
| B1572 | C1572-DV27PG5 | 0/6 | 0/6 | 0/6 | 1/6 | 0/6 | 0/6 | NA | NA | NA |
| A1550 | C1550-DV27PG5 | 0/6 | 0/6 | 0/6 | 0/6 | 0/6 | 0/6 | NA | NA | NA |
| A1573 | C1573-DV29PG5 | 0/6 | 0/6 | 0/6 | 0/6 | 0/6 | 0/6 | NA | NA | NA |
| ANC | CNC-G5 | 0/6 | 0/6 | 0/6 | 0/6 | 0/6 | 0/6 | 0/6 | 0/6 | 0/6 |
| | PBS | 0/6 | 0/6 | 0/6 | 0/6 | 0/6 | 0/6 | 0/6 | 0/6 | 0/6 |

TABLE 56

Changes in the number of mice producing antibodies across sequence groups

| Unmodified sequence code | Sequence code | Number of mice producing antibodies | | | | | | | | |
|---|---|---|---|---|---|---|---|---|---|---|
| | | D 7 | D 14 | D 21 | D 28 | D 35 | D 42 | D 49 | D 56 | D 63 |
| B418S | C418S-DV34Pd7BG5 | 2/6 | 4/6 | 4/6 | 4/6 | 6/6 | 6/6 | 6/6 | 6/6 | 4/6 |
| B207S | C207S-DV32PG5 | 2/6 | 2/6 | 3/6 | 3/6 | 4/6 | 4/6 | 4/6 | 5/6 | 5/6 |
| B1575 | C1575-DV27PG5 | 0/6 | 1/6 | 2/6 | 0/6 | 0/6 | 2/6 | 2/6 | 2/6 | 2/6 |
| B207S | C207S-DV29PG5 | 1/6 | 4/6 | 1/6 | 2/6 | 3/6 | 5/6 | 5/6 | 4/6 | 5/6 |
| APC | VIR-2218-GL | 2/6 | 3/6 | 3/6 | 3/6 | 3/6 | 3/6 | 2/6 | 2/6 | 1/6 |
| A416 | C416-DV27Pd7BG5 | 2/6 | 2/6 | 3/6 | 2/6 | 0/6 | 0/6 | NA | NA | NA |
| B1575 | C1575-DV29PG5 | 0/6 | 0/6 | 0/6 | 0/6 | 0/6 | 0/6 | NA | NA | NA |
| B1572 | C1572-DV27PG5 | 0/6 | 0/6 | 0/6 | 0/6 | 0/6 | 0/6 | NA | NA | NA |
| A1550 | C1550-DV27PG5 | 0/6 | 0/6 | 0/6 | 0/6 | 0/6 | 0/6 | NA | NA | NA |
| A1573 | C1573-DV29PG5 | 0/6 | 0/6 | 0/6 | 0/6 | 0/6 | 1/6 | NA | NA | NA |
| ANC | CNC-G5 | 0/6 | 0/6 | 0/6 | 0/6 | 0/6 | 0/6 | 0/6 | 0/6 | 0/6 |
| | PBS | 0/6 | 0/6 | 0/6 | 0/6 | 0/6 | 0/6 | 0/6 | 0/6 | 0/6 |

TABLE 57

Changes in plasma HBsAb levels in mice across sequence groups

| Unmodified sequence code | Sequence code | HBsAb (mIU/mL) | | | | | | | | |
|---|---|---|---|---|---|---|---|---|---|---|
| | | D 7 | D 14 | D 21 | D 28 | D 35 | D 42 | D 49 | D 56 | D 63 |
| B418S | C418S-DV34Pd7BG5 | 35 | 117 | 257 | 180 | 145 | 191 | 311 | 293 | 363 |
| B207S | C207S-DV32PG5 | 52 | 88 | 69 | 65 | 84 | 111 | 237 | 383 | 597 |
| B1575 | C1575-DV27PG5 | 30 | 30 | 34 | 30 | 30 | 33 | 34 | 49 | 37 |
| B207S | C207S-DV29PG5 | 37 | 39 | 31 | 31 | 64 | 119 | 179 | 172 | 264 |
| APC | VIR-2218-GL | 31 | 92 | 226 | 306 | 362 | 203 | 161 | 142 | 97 |
| A416 | C416-DV27Pd7BG5 | 33 | 36 | 39 | 34 | 30 | 30 | NA | NA | NA |
| B1575 | C1575-DV29PG5 | 30 | 30 | 30 | 30 | 30 | 30 | NA | NA | NA |
| B1572 | C1572-DV27PG5 | 30 | 30 | 30 | 30 | 30 | 30 | NA | NA | NA |
| A1550 | C1550-DV27PG5 | 30 | 30 | 30 | 30 | 30 | 30 | NA | NA | NA |
| A1573 | C1573-DV29PG5 | 30 | 30 | 30 | 30 | 30 | 31 | NA | NA | NA |
| ANC | CNC-G5 | 30 | 30 | 30 | 30 | 30 | 30 | 30 | 30 | 30 |
| | PBS | 30 | 30 | 30 | 30 | 30 | 30 | 30 | 30 | 30 |

TABLE 58

Changes in plasma ALT levels in mice across sequence groups

| Unmodified sequence code | Sequence code | ALT (U/L) D 7 | D 14 | D 21 | D 28 | D 35 | D 42 | D 49 | D 56 | D 63 |
|---|---|---|---|---|---|---|---|---|---|---|
| B418S | C418S-DV34Pd7BG5 | 75 | 83 | 138 | 75 | 75 | 80 | 75 | 80 | 75 |
| B207S | C207S-DV32PG5 | 75 | 78 | 75 | 78 | 75 | 78 | 75 | 75 | 95 |
| B1575 | C1575-DV27PG5 | 75 | 75 | 75 | 75 | 75 | 75 | 75 | 75 | 78 |
| B207S | C207S-DV29PG5 | 75 | 75 | 75 | 98 | 75 | 78 | 223 | 75 | 75 |
| APC | VIR-2218-GL | 75 | 75 | 85 | 75 | 75 | 75 | 98 | 105 | 103 |
| A416 | C416-DV27Pd7BG5 | 75 | 75 | 75 | 75 | 75 | 75 | NA | NA | NA |
| B1575 | C1575-DV29PG5 | 75 | 75 | 75 | 75 | 75 | 75 | NA | NA | NA |
| B1572 | C1572-DV27PG5 | 75 | 75 | 75 | 83 | 75 | 75 | NA | NA | NA |
| A1550 | C1550-DV27PG5 | 75 | 80 | 88 | 83 | 75 | 75 | NA | NA | NA |
| A1573 | C1573-DV29PG5 | 75 | 75 | 75 | 75 | 75 | 75 | NA | NA | NA |
| ANC | CNC-G5 | 75 | 75 | 75 | 75 | 75 | 75 | 75 | 75 | 83 |
| | PBS | 75 | 75 | 75 | 75 | 75 | 75 | 75 | 75 | 78 |

TABLE 59

Changes in body weight of mice across sequence groups

| Unmodified sequence code | Sequence code | Body weight (g) D 7 | D 14 | D 21 | D 28 | D 35 | D 42 | D 49 | D 56 | D 63 |
|---|---|---|---|---|---|---|---|---|---|---|
| B418S | C418S-DV34Pd7BG5 | 28.9 | 29.2 | 28.8 | 28.8 | 29.1 | 29.9 | 30.3 | 30.5 | 29.8 |
| B207S | C207S-DV32PG5 | 29.2 | 29.7 | 29.9 | 30.0 | 30.0 | 30.0 | 31.0 | 31.2 | 31.2 |
| B1575 | C1575-DV27PG5 | 27.7 | 28.3 | 28.2 | 28.4 | 28.7 | 28.6 | 29.0 | 29.0 | 28.6 |
| B207S | C207S-DV29PG5 | 27.4 | 27.6 | 27.7 | 27.6 | 27.7 | 28.1 | 28.3 | 28.5 | 28.1 |
| APC | VIR-2218-GL | 28.4 | 28.9 | 29.0 | 28.6 | 29.4 | 29.6 | 30.0 | 30.2 | 29.9 |
| A416 | C416-DV27Pd7BG5 | 29.7 | 30.6 | 30.0 | 30.0 | 29.8 | 30.8 | NA | NA | NA |
| B1575 | C1575-DV29PG5 | 29.4 | 30.0 | 30.0 | 29.4 | 29.8 | 29.8 | NA | NA | NA |
| B1572 | C1572-DV27PG5 | 29.6 | 29.9 | 30.2 | 30.1 | 29.2 | 29.2 | NA | NA | NA |
| A1550 | C1550-DV27PG5 | 28.1 | 28.7 | 28.5 | 29.0 | 29.2 | 29.2 | NA | NA | NA |
| A1573 | C1573-DV29PG5 | 27.5 | 27.6 | 27.3 | 27.3 | 27.0 | 27.6 | NA | NA | NA |
| ANC | CNC-G5 | 28.4 | 29.0 | 29.2 | 28.6 | 28.9 | 29.4 | 29.5 | 29.7 | 29.8 |
| | PBS | 29.2 | 29.8 | 30.2 | 30.0 | 30.2 | 30.2 | 31.0 | 32.3 | 32.4 |

Figure 2A:
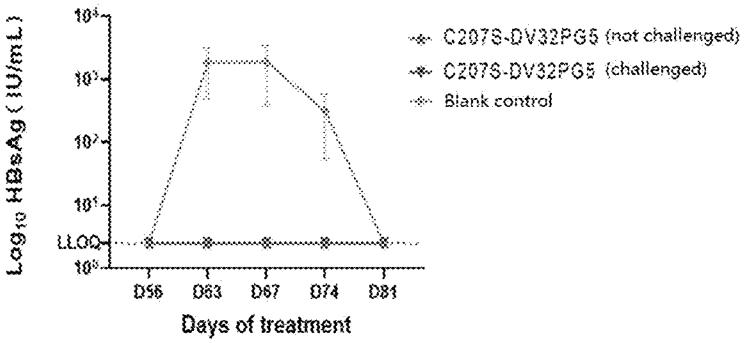
FIG. 2A shows serum HBsAg levels in mice after secondary viral challenge.
Figure 2B:
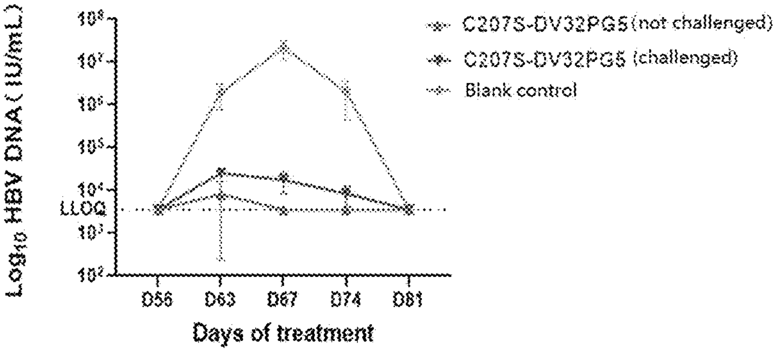
FIG. 2B shows serum HBV DNA levels in mice after secondary viral challenge.
Figure 2C:
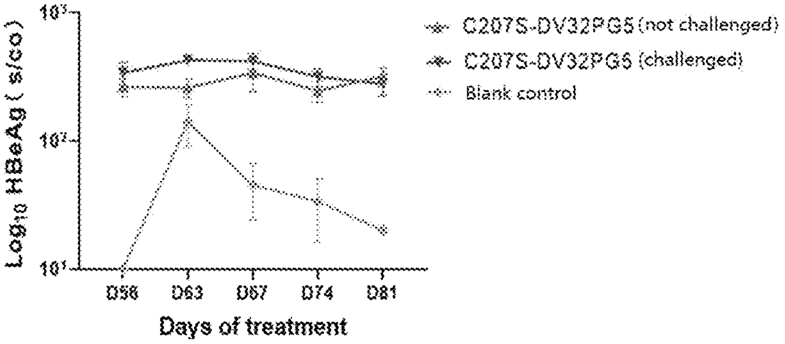
FIG. 2C shows serum HBeAg levels in mice after secondary viral challenge.
Figure 2D:
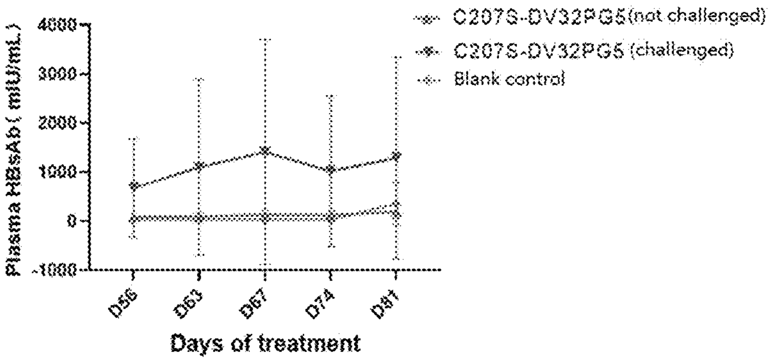
FIG. 2D shows serum HBbAg levels in mice after secondary viral challenge.
Figure 2E:
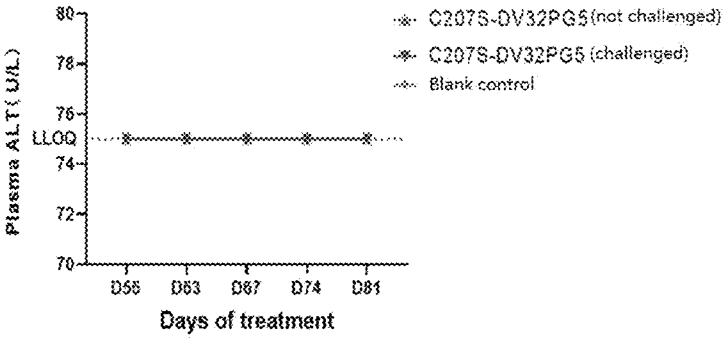
FIG. 2E shows serum ALT levels in mice after secondary viral challenge.
Figure 2F:
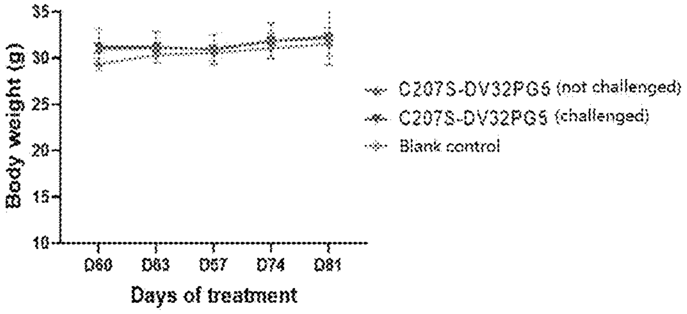
FIG. 2F shows body weight changes in mice after secondary viral challenge.

(ii) Protective Effect of Sequence C207S-DV32PG5 Against Secondary Challenge in Mice The mice in the C207S-DV32PG5 group were subjected to hydrodynamic tail vein injection of HBV plasmid on D60 to simulate secondary HBV infection. As shown in FIGS. 2A-2F, the blank control group (mice not previously infected with HBV before D56) exhibited detectable levels of HBsAg, HBeAg, and HBV DNA after the hydrodynamic injection of the HBV plasmid, confirming the effectiveness of the challenge method. In the C207S-DV32PG5 challenge group, HBV DNA levels initially increased post-challenge but subsequently declined to below the detection limit. Concurrently, serum HBsAb levels significantly increased, while HBsAg remained below the detection limit. These results confirm the effectiveness of the challenge and demonstrate that mice treated with this small nucleic acid sequence were protected against reinfection with HBV.

Example 8: Inhibition of HBV in Mice by Sequences Modified with the Templates (Low Dose) of the Present Disclosure This example exemplarily selects several sequences, including sequences C207S-DV32PG5, C207S-DV29PG5, C418S-DV34Pd7BG5, and C1575-DV27PG5 from Example 7, as shown in Table 49, to analyze the in vivo efficacy of these RNAi agents at a low dose (e.g., 0.5 mg/kg) following multiple administrations in an AAV-HBV mouse model.

1. Experimental Materials

Sequences C207S-DV32PG5, C207S-DV29PG5, C418S-DV34Pd7BG5, and C1575-DV27PG5 from Example 7 and VIR-2218-GL are shown in Table 49. And Entecavir (ETV).

2. Experimental Methods

The experimental method is the same as Example 7, with details on grouping and administration as shown in Table 60.

TABLE 60

Group settings and administration details

| Group | Administration regimen | Administration route | Number of animals |
|---|---|---|---|
| siRNA (6 groups) | 0.5 mg/kg, administered on D 0, D 7, and D 14 | s.c. | 6 mice/group × 6 group |
| ETV (1 group) | 0.1 mg/kg, daily | i.g. | 6 mice/group × 1 group |
| Vehicle control (1 group) | PBS, administered once on D 0, D 7, and D 14 | s.c. | 6 mice/group × 1 group |

Note:
s.c. represents subcutaneous injection; i.g. represents intragastric administration.

3. Experimental Results

Figure 3A:
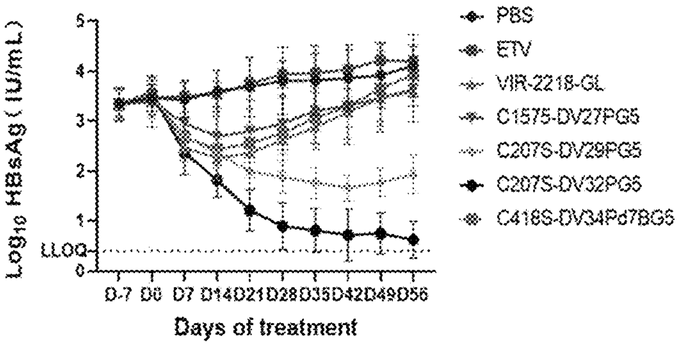
FIG. 3A shows HBsAg levels in AAV-HBV model mice at a dose of 0.5 mg/kg of the candidate siRNA sequence.
Figure 3B:
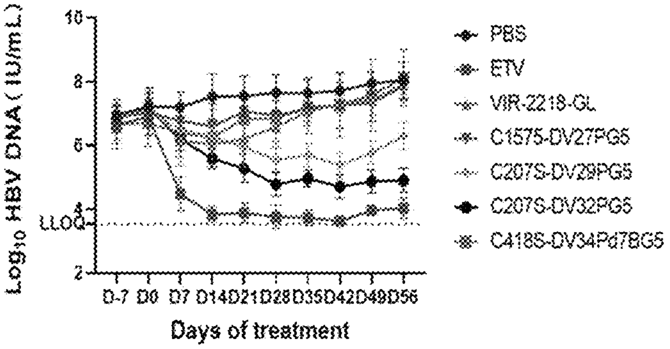
FIG. 3B shows HBV DNA levels in AAV-HBV model mice at a dose of 0.5 mg/kg of the candidate siRNA sequence.
Figure 3C:
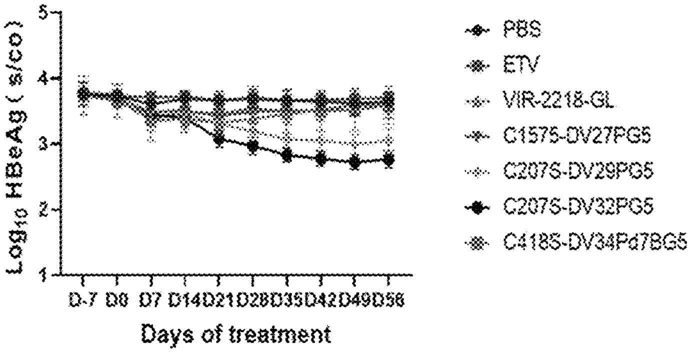
FIG. 3C shows HBeAg levels in AAV-HBV model mice at a dose of 0.5 mg/kg of the candidate siRNA sequence.
Figure 3D:
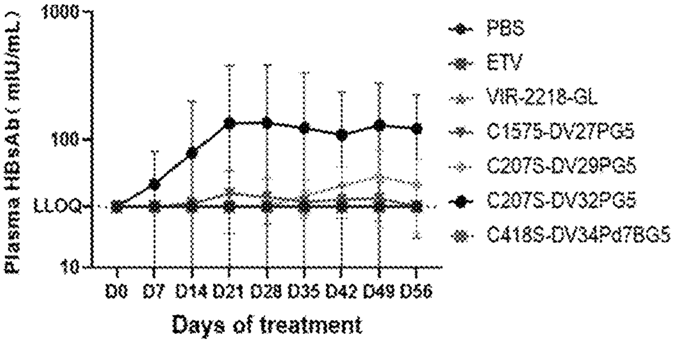
FIG. 3D shows HBsAb levels in AAV-HBV model mice at a dose of 0.5 mg/kg of the candidate siRNA sequence.
Figure 3E:
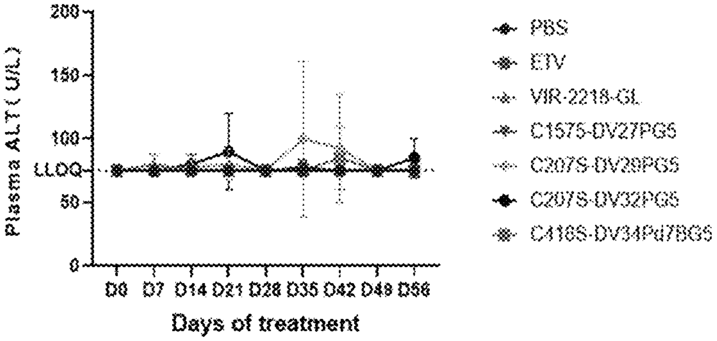
FIG. 3E shows ALT levels in AAV-HBV model mice at a dose of 0.5 mg/kg of the candidate siRNA sequence.
Figure 3F:
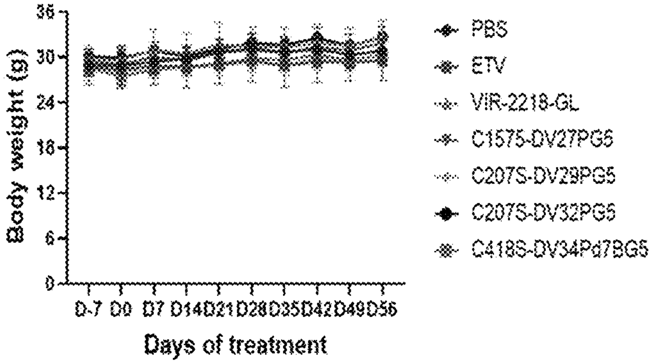
FIG. 3F shows body weight changes in AAV-HBV model mice at a dose of 0.5 mg/kg of the candidate siRNA sequence.

The changes in HBsAg, HBeAg, HBV DNA, HBsAb, and ALT levels in mice from each group over time are shown in Tables 61-68 and FIGS. 3A-3F. The experimental results indicate that the sequences C207S-DV32PG5 and C207S-DV29PG5 significantly outperformed the positive control sequence VIR-2218-GL in inhibiting HBsAg, HBV DNA, and HBeAg. Among them, C2071-DV32PG demonstrated the most effective results, reducing HBsAg by approximately 2.9 log CO by day 56, which was about 1.4 log 10 higher tan tat of C207S-DV29PG5. Additionally, by day 56, HBsAg became undetectable in 3 mice, and 4 mice developed antibodies in the C207S-DV32PG5 group, while no mice in the C207S-DV29PG5 group showed HBsAg clearance. These data further confirm the superior therapeutic efficacy of the sequence C207S-DV32PG5.

TABLE 61

Changes in plasma HBsAg levels in mice across sequence groups

| Unmodified sequence code | Sequence code | Log10 HBsAg (IU/mL) | | | | | | | | | |
|---|---|---|---|---|---|---|---|---|---|---|---|
| | | D −7 | D 0 | D 7 | D 14 | D 21 | D 28 | D 35 | D 42 | D 49 | D 56 |
| / | PBS | 3.36 ± 0.30 | 3.46 ± 0.27 | 3.43 ± 0.36 | 3.61 ± 0.41 | 3.69 ± 0.59 | 3.81 ± 0.68 | 3.81 ± 0.70 | 3.86 ± 0.67 | 3.92 ± 0.65 | 4.10 ± 0.62 |
| / | ETV | 3.36 ± 0.26 | 3.47 ± 0.34 | 3.50 ± 0.33 | 3.54 ± 0.25 | 3.74 ± 0.14 | 3.94 ± 0.27 | 3.96 ± 0.39 | 4.04 ± 0.40 | 4.22 ± 0.33 | 4.20 ± 0.30 |
| APC | VIR-2218-GL | 3.33 ± 0.33 | 3.60 ± 0.24 | 2.47 ± 0.27** | 2.26 ± 0.45* | 2.36 ± 0.42** | 2.62 ± 0.28 | 2.88 ± 0.34 | 3.18 ± 0.29 | 3.46 ± 0.47 | 3.59 ± 0.30 |
| B1575 | C1575-DV27PG5 | 3.34 ± 0.34 | 3.40 ± 0.52 | 2.96 ± 0.49 | 2.69 ± 0.57 | 2.80 ± 0.62* | 2.95 ± 0.52 | 3.21 ± 0.65 | 3.23 ± 0.92 | 3.46 ± 0.68 | 3.64 ± 0.66 |
| B207S | C207S-DV29PG5 | 3.33 ± 0.33 | 3.51 ± 0.30 | 2.70 ± 0.22** | 2.36 ± 0.29* | 2.00 ± 0.33** | 1.88 ± 0.32 | 1.77 ± 0.31* | 1.67 ± 0.27* | 1.77 ± 0.29* | 1.94 ± 0.40 |
| B207S | C207S-DV32PG5 | 3.33 ± 0.32 | 3.55 ± 0.34 | 2.37 ± 0.43** | 1.82 ± 0.34** | 1.22 ± 0.41** | 0.90 ± 0.47** | 0.82 ± 0.44** | 0.79 ± 0.67** | 0.75 ± 0.41** | 0.63 ± 0.37** |
| B418S | C418S-DV34Pd7BG5 | 3.33 ± 0.33 | 3.40 ± 0.32 | 2.68 ± 0.40** | 2.43 ± 0.66* | 2.56 ± 0.69** | 2.76 ± 0.77 | 3.06 ± 0.63 | 3.30 ± 0.65 | 3.65 ± 0.75 | 3.93 ± 0.61 |

Note:
Compared to the PBS group:
*indicates $P < 0.05$;
**indicates $P < 0.01$.

TABLE 62

Changes in plasma HBV DNA levels in mice across sequence groups

| Unmodified sequence code | Sequence code | Log10 HBV DNA (IU/mL) | | | | | | | | | |
|---|---|---|---|---|---|---|---|---|---|---|---|
| | | D −7 | D 0 | D 7 | D 14 | D 21 | D 28 | D 35 | D 42 | D 49 | D 56 |
| / | PBS | 6.97 ± 0.28 | 7.22 ± 0.41 | 7.20 ± 0.49 | 7.54 ± 0.72 | 7.55 ± 0.63 | 7.65 ± 0.57 | 7.65 ± 0.46 | 7.72 ± 0.56 | 7.96 ± 0.35 | 8.05 ± 0.57 |
| / | ETV | 6.65 ± 0.58 | 6.91 ± 0.58 | 4.49 ± 0.54** | 3.85 ± 0.24** | 3.89 ± 0.31** | 3.77 ± 0.37** | 3.74 ± 0.25** | 3.63 ± 0.08** | 3.97 ± 0.13** | 4.04 ± 0.32** |
| APC | VIR-2218-GL | 6.81 ± 0.63 | 7.20 ± 0.15 | 6.16 ± 0.78 | 6.03 ± 0.76 | 6.22 ± 0.88 | 6.59 ± 0.46 | 7.07 ± 0.31 | 7.31 ± 0.27 | 7.43 ± 0.47 | 7.92 ± 0.29 |
| B1575 | C1575-DV27PG5 | 6.87 ± 0.43 | 7.04 ± 0.66 | 6.78 ± 0.48 | 6.60 ± 0.70 | 7.07 ± 0.40 | 6.95 ± 0.44 | 7.15 ± 0.52 | 7.09 ± 1.14 | 7.34 ± 0.58 | 7.86 ± 0.44 |
| B207S | C207S-DV29PG5 | 6.98 ± 0.23 | 7.07 ± 0.39 | 6.51 ± 0.25 | 6.29 ± 0.33 | 5.95 ± 0.19 | 5.56 ± 0.36 | 5.70 ± 0.37 | 5.38 ± 0.40 | 5.78 ± 0.37 | 6.31 ± 0.44 |
| B207S | C207S-DV32PG5 | 6.83 ± 0.42 | 7.23 ± 0.58 | 6.20 ± 0.35 | 5.59 ± 0.28 | 5.29 ± 0.43 | 4.79 ± 0.36 | 4.97 ± 0.26 | 4.83 ± 0.57 | 4.88 ± 0.36* | 4.91 ± 0.38* |
| B418S | C418S-DV34Pd7BG5 | 6.68 ± 0.78 | 6.71 ± 0.75 | 6.39 ± 0.75 | 6.25 ± 0.88 | 6.84 ± 0.67 | 6.85 ± 0.91 | 7.21 ± 0.84 | 7.28 ± 1.00 | 7.58 ± 1.12 | 8.12 ± 0.89 |

Note:
Compared to the PBS group:
*indicates $P < 0.05$;
**indicates $P < 0.01$.

TABLE 63

Changes in plasma HBeAg levels in mice across sequence groups

| Unmodified sequence code | Sequence code | Log10 HBeAg (S/CO) D −7 | D 0 | D 7 | D 14 | D 21 | D 28 | D 35 | D 42 | D 49 | D 56 |
|---|---|---|---|---|---|---|---|---|---|---|---|
| / | PBS | 3.76 ± 0.17 | 3.73 ± 0.10 | 3.61 ± 0.07 | 3.69 ± 0.13 | 3.67 ± 0.14 | 3.69 ± 0.14 | 3.66 ± 0.15 | 3.65 ± 0.13 | 3.62 ± 0.19 | 3.24 ± 1.01 |
| / | ETV | 3.77 ± 0.06 | 3.73 ± 0.06 | 3.72 ± 0.05 | 3.72 ± 0.03 | 3.66 ± 0.05 | 3.71 ± 0.06 | 3.66 ± 0.05 | 3.68 ± 0.05 | 3.69 ± 0.08 | 3.70 ± 0.04 |
| APC | VIR-2218-GL | 3.78 ± 0.11 | 3.77 ± 0.13 | 3.35 ± 0.15* | 3.39 ± 0.15 | 3.32 ± 0.19 | 3.39 ± 0.19 | 3.46 ± 0.17 | 3.52 ± 0.12 | 3.60 ± 0.13 | 3.59 ± 0.13 |
| B1575 | C1575-DV27PG5 | 3.75 ± 0.19 | 3.68 ± 0.13 | 3.48 ± 0.12 | 3.51 ± 0.18 | 3.43 ± 0.20 | 3.50 ± 0.15 | 3.51 ± 0.17 | 3.37 ± 0.38 | 3.60 ± 0.16 | 3.59 ± 0.20 |
| B207S | C207S-DV29PG5 | 3.78 ± 0.06 | 3.70 ± 0.07 | 3.50 ± 0.13 | 3.47 ± 0.09 | 3.31 ± 0.12 | 3.20 ± 0.13 | 3.07 ± 0.11 | 3.06 ± 0.15 | 3.00 ± 0.14 | 3.05 ± 0.18 |
| B207S | C207S-DV32PG5 | 3.77 ± 0.04 | 3.72 ± 0.04 | 3.45 ± 0.04** | 3.40 ± 0.12 | 3.08 ± 0.13 | 2.97 ± 0.12 | 2.84 ± 0.10* | 2.94 ± 0.35 | 2.73 ± 0.11* | 2.77 ± 0.13 |
| B418S | C418S-DV34Pd7BG5 | 3.74 ± 0.30 | 3.66 ± 0.26 | 3.38 ± 0.33 | 3.49 ± 0.31 | 3.46 ± 0.30 | 3.55 ± 0.33 | 3.49 ± 0.34 | 3.51 ± 0.31 | 3.52 ± 0.32 | 3.59 ± 0.28 |

Note:
Compared to the PBS group:
*indicates P < 0.05;
**indicates P < 0.01.

TABLE 64

Number of mice with HBsAg clearance in plasma across sequence groups

| Unmodified sequence code | Sequence code | Number of mice with HBsAg clearance D 7 | D 14 | D 21 | D 28 | D 35 | D 42 | D 49 | D 56 |
|---|---|---|---|---|---|---|---|---|---|
| B207S | C207S-DV32PG5 | 0 | 0 | 0 | 1 | 1 | 2 | 1 | 3 |
| B207S | C207S-DV29PG5 | 0 | 0 | 0 | 0 | 0 | 0 | 0 | 0 |
| B418S | C418S-DV34Pd7BG5 | 0 | 0 | 0 | 0 | 0 | 0 | 0 | 0 |
| B1575 | C1575-DV27PG5 | 0 | 0 | 0 | 0 | 0 | 0 | 0 | 0 |
| APC | VIR-2218-GL | 0 | 0 | 0 | 0 | 0 | 0 | 0 | 0 |
| / | ETV | 0 | 0 | 0 | 0 | 0 | 0 | 0 | 0 |
| / | PBS | 0 | 0 | 0 | 0 | 0 | 0 | 0 | 0 |

TABLE 65

Number of mice with HBV DNA clearance in plasma across sequence groups

| Unmodified sequence code | Sequence code | Number of mice with HBV DNA clearance D 7 | D 14 | D 21 | D 28 | D 35 | D 42 | D 49 | D 56 |
|---|---|---|---|---|---|---|---|---|---|
| B207S | C207S-DV32PG5 | 0 | 0 | 0 | 0 | 0 | 0 | 0 | 0 |
| B207S | C207S-DV29PG5 | 0 | 0 | 0 | 0 | 0 | 0 | 0 | 0 |
| B418S | C418S-DV34Pd7BG5 | 0 | 0 | 0 | 0 | 0 | 0 | 0 | 0 |
| B1575 | C1575-DV27PG5 | 0 | 0 | 0 | 0 | 0 | 0 | 0 | 0 |
| APC | VIR-2218-GL | 0 | 0 | 0 | 0 | 0 | 0 | 0 | 0 |
| / | ETV | 1 | 1 | 1 | 3 | 3 | 2 | 0 | 0 |
| / | PBS | 0 | 0 | 0 | 0 | 0 | 0 | 0 | 0 |

TABLE 66

Number of mice producing HBsAb across sequence groups

| Unmodified sequence code | Sequence code | Number of mice producing HBsAb D 7 | D 14 | D 21 | D 28 | D 35 | D 42 | D 49 | D 56 |
|---|---|---|---|---|---|---|---|---|---|
| B207S | C207S-DV32PG5 | 1 | 1 | 2 | 3 | 4 | 4 | 4 | 4 |
| B207S | C207S-DV29PG5 | 0 | 0 | 0 | 0 | 2 | 3 | 3 | 2 |

TABLE 66-continued

| Number of mice producing HBsAb across sequence groups | | | | | | | | | |
|---|---|---|---|---|---|---|---|---|---|
| Unmodified | | Number of mice producing HBsAb | | | | | | | |
| sequence code | Sequence code | D 7 | D 14 | D 21 | D 28 | D 35 | D 42 | D 49 | D 56 |
| B418S | C418S-DV34Pd7BG5 | 0 | 0 | 0 | 0 | 0 | 0 | 0 | 0 |
| B1575 | C1575-DV27PG5 | 0 | 1 | 1 | 1 | 1 | 1 | 1 | 0 |
| APC | VIR-2218-GL | 0 | 0 | 0 | 0 | 0 | 0 | 0 | 0 |
| / | ETV | 0 | 0 | 0 | 0 | 0 | 0 | 0 | 0 |
| / | PBS | 0 | 0 | 0 | 0 | 0 | 0 | 0 | 0 |

TABLE 67

| Changes in plasma HBsAb levels in mice across sequence groups | | | | | | | | | |
|---|---|---|---|---|---|---|---|---|---|
| Unmodified | | HBsAb (mIU/mL) | | | | | | | |
| sequence code | Sequence code | D 7 | D 14 | D 21 | D 28 | D 35 | D 42 | D 49 | D 56 |
| B207S | C207S-DV32PG5 | 45 | 79 | 135 | 136 | 124 | 109 | 130 | 122 |
| B207S | C207S-DV29PG5 | 30 | 30 | 30 | 30 | 36 | 44 | 52 | 44 |
| B418S | C418S-DV34Pd7BG5 | 30 | 30 | 30 | 30 | 30 | 30 | 30 | 30 |
| B1575 | C1575-DV27PG5 | 30 | 32 | 38 | 36 | 33 | 34 | 35 | 30 |
| APC | VIR-2218-GL | 30 | 30 | 30 | 30 | 30 | 30 | 30 | 30 |
| | ETV | 30 | 30 | 30 | 30 | 30 | 30 | 30 | 30 |
| | PBS | 30 | 30 | 30 | 30 | 30 | 30 | 30 | 30 |

TABLE 68

| Changes in plasma ALT levels in mice across sequence groups | | | | | | | | | |
|---|---|---|---|---|---|---|---|---|---|
| Unmodified | | ALT (U/L) | | | | | | | |
| sequence code | Sequence code | D 7 | D 14 | D 21 | D 28 | D 35 | D 42 | D 49 | D 56 |
| B207S | C207S-DV32PG5 | 75 | 80 | 90 | 75 | 78 | 75 | 75 | 85 |
| B207S | C207S-DV29PG5 | 75 | 78 | 80 | 75 | 100 | 93 | 75 | 75 |
| B418S | C418S-DV34Pd7BG5 | 75 | 75 | 75 | 75 | 75 | 85 | 75 | 75 |
| B1575 | C1575-DV27PG5 | 75 | 75 | 75 | 75 | 75 | 75 | 75 | 75 |
| APC | VIR-2218-GL | 80 | 75 | 75 | 75 | 75 | 75 | 75 | 75 |
| | ETV | 75 | 75 | 75 | 75 | 75 | 75 | | |
| | PBS | 75 | 75 | 75 | 75 | 75 | 75 | | |

Example 9: Inhibition of HBV in Mice Using Sequences Modified with Delivery Ligands of the Present Disclosure This example exemplarily selects certain sequences, including the unmodified sequences B418S and B207S, which are modified in various ways, such as template modification alone or template modification combined with anti-off-target design, and conjugated with different delivery ligands. The in vivo efficacy of these RNAi agents was analyzed using an AAV-HBV mouse model.

1. Experimental Materials

Test Compounds:

The sequences listed in Table 69 include sequences with only template modifications and sequences with both template modifications and anti-off-target designs. The 3' end of the sense strand of these sequences is conjugated with delivery ligands G5, G101, or G103, with the structural formula as follows:

G5
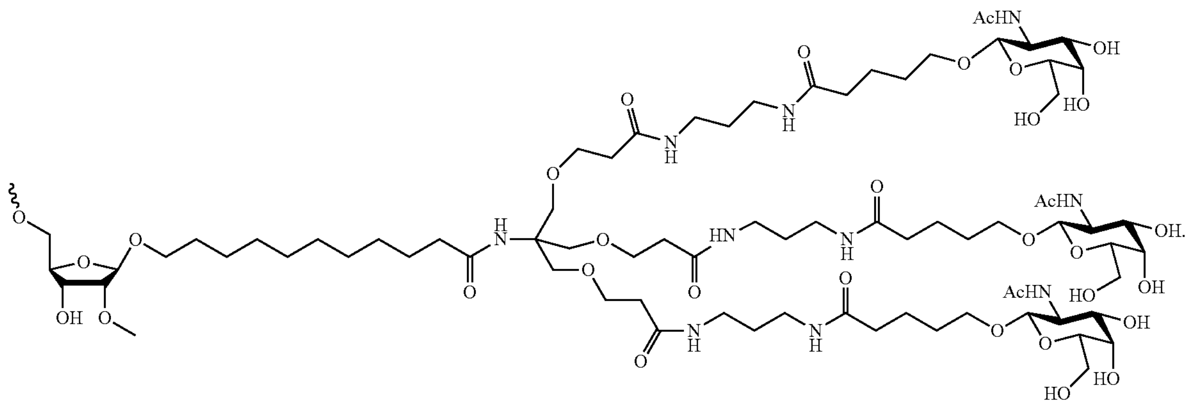
G101
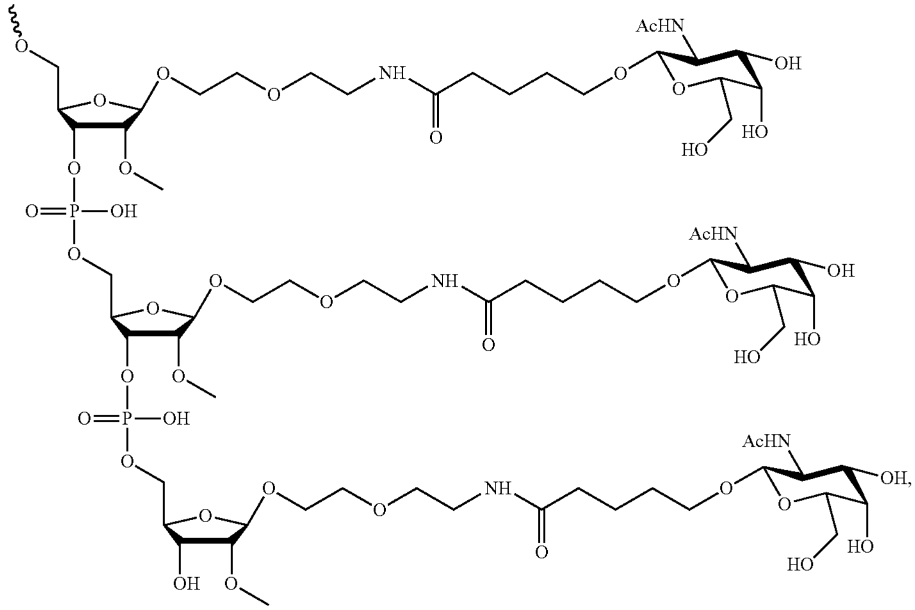
G103
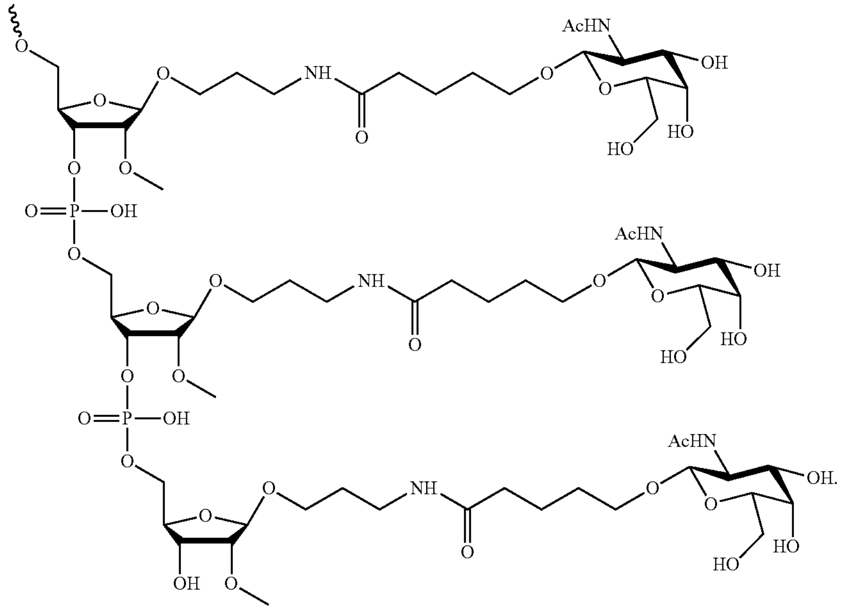

The conjugation method of the oligonucleotide with the ligand G5, G101 or G103 refers to the preparation method described in Example 3 of the patent application CN116854754A.
The oligonucleotide and ligand G5, G101 or G103 form the conjugate as shown below:
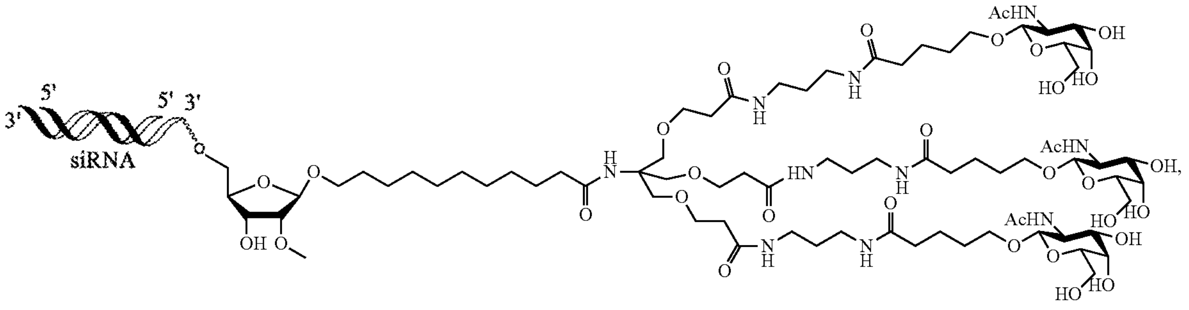
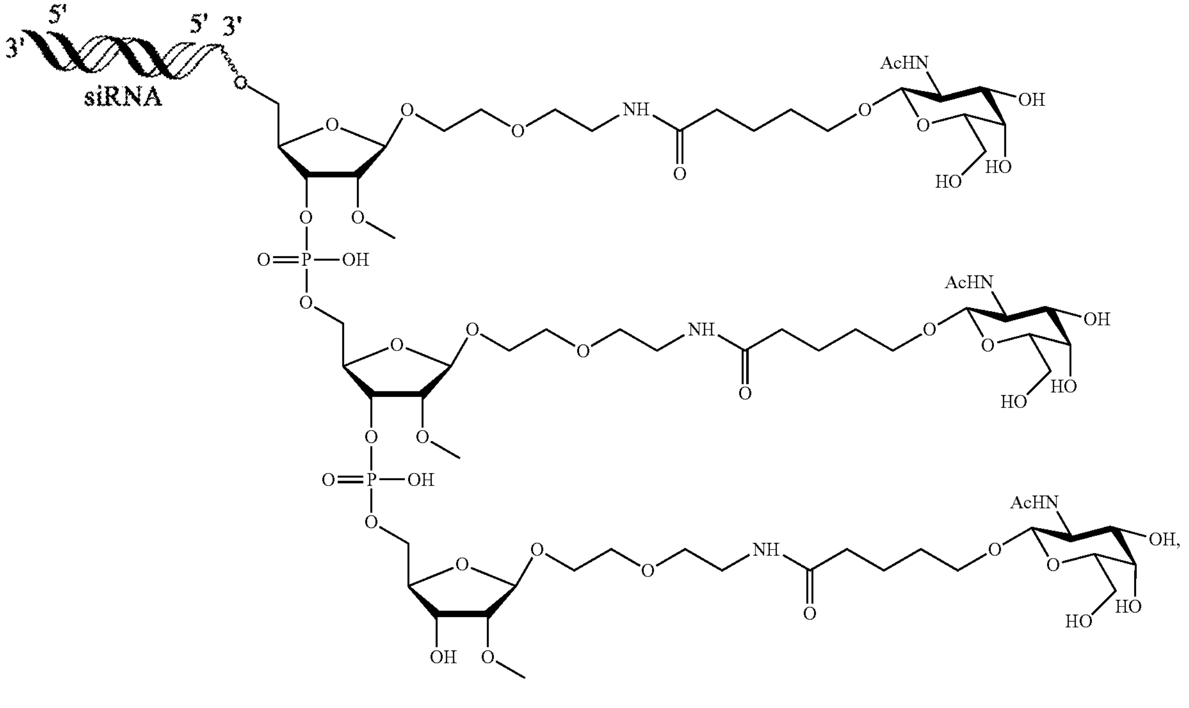

-continued

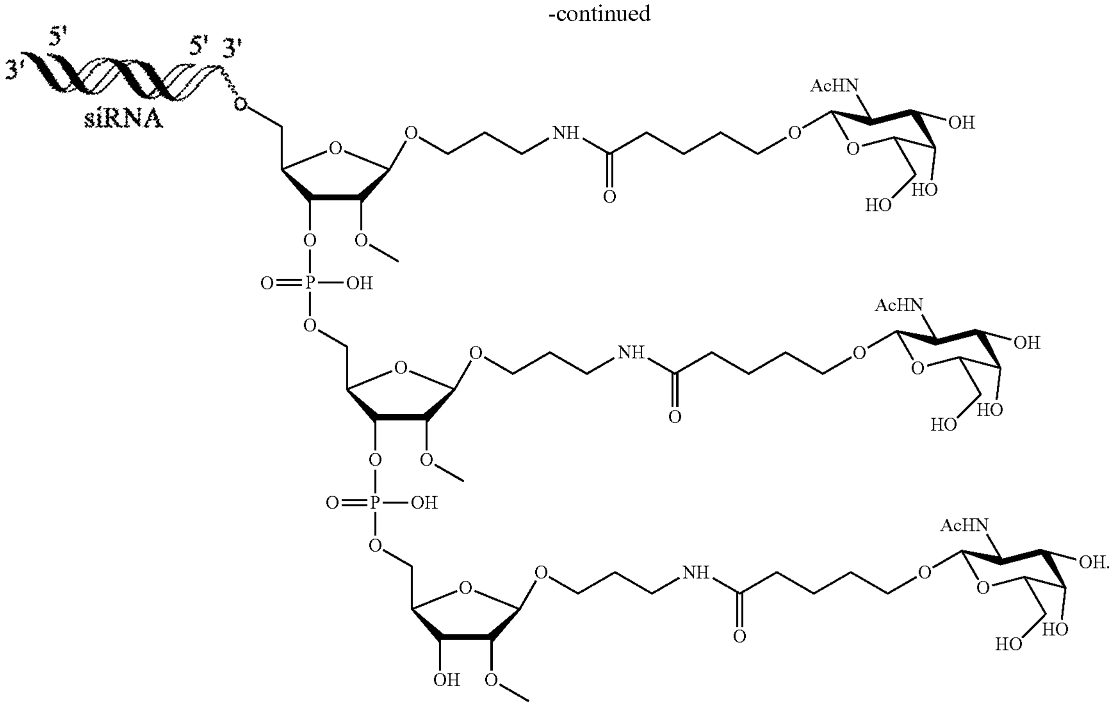

The specific sequences for each sequence can be found in Table 69. In the sequence codes, G5 indicates that the sequence is conjugated with the delivery ligand G5, G101 indicates conjugation with the delivery ligand G101, G103 indicates conjugation with the delivery ligand G103, and GL indicates conjugation with the delivery ligand L96. The structural formula of L96 is as follows:

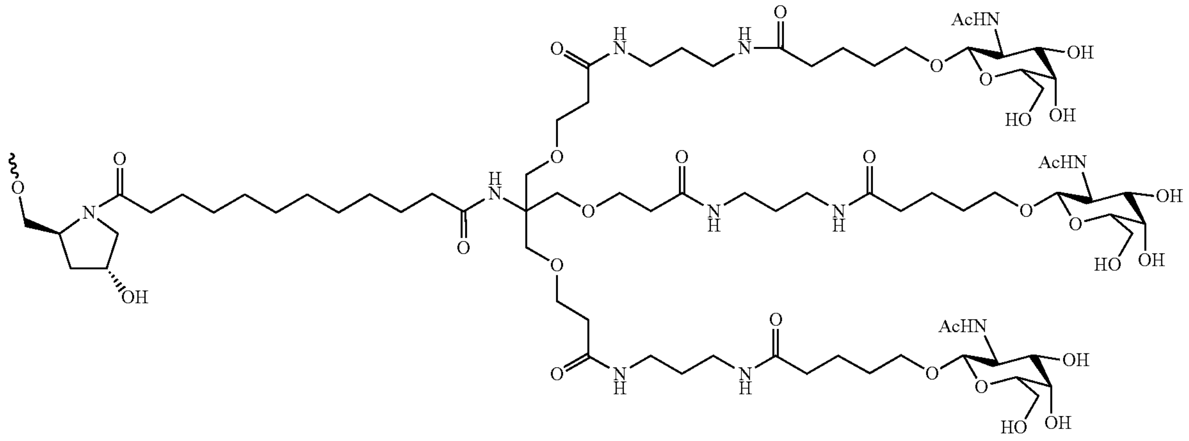

TABLE 69 siRNA sequences used in animal experiments

| Unmodified sequence code | Sequence code | Sense strand sequence 5'-3' | Sequence ID No | Unmodified sequence ID No | Antisense strand sequence 5'-3' | Sequence ID No | Unmodified sequence ID No |
|---|---|---|---|---|---|---|---|
| B207S | C207S-DV29PG5 | Gms-Gms-Gm-Gm-Um-Uf-Um-Uf-Um-Cf-Um-Um-Gm-Um-Um-Gf-Am-Cm-Am-Am-G5 | 326 | 1 | UmsEVP-Ufs-Gm-Uf-Cf-Af-Am-Cm-Am-Am-Gm-Am-Am-Af-Am-Af-Cm-Cm-Cm-Cms-Gms-Cm | 179 | 8 |

TABLE 69-continued siRNA sequences used in animal experiments

| Unmodified sequence code | Sequence code | Sense strand sequence 5'-3' | Sequence ID No | Unmodified sequence ID No | Antisense strand sequence 5'-3' | Sequence ID No | Unmodified sequence ID No |
|---|---|---|---|---|---|---|---|
| B207S | C207S-DV29PG101 | Gms-Gms-Gm-Gm-Um-Uf-Um-Uf-Um-Cf-Um-Um-Gm-Um-Um-Gf-Am-Cm-Am-Am-G101 | 327 | 1 | UmsEVP-Ufs-Gm-Uf-Cf-Af-Am-Cm-Am-Am-Gm-Am-Am-Af-Am-Af-Cm-Cm-Cm-Cms-Gms-Cm | 179 | 8 |
| B207S | C207S-DV29PG103 | Gms-Gms-Gm-Gm-Um-Uf-Um-Uf-Um-Cf-Um-Um-Gm-Um-Um-Gf-Am-Cm-Am-Am-G103 | 328 | 1 | UmsEVP-Ufs-Gm-Uf-Cf-Af-Am-Cm-Am-Am-Gm-Am-Am-Af-Am-Af-Cm-Cm-Cm-Cms-Gms-Cm | 179 | 8 |
| B207S | C207S-DV32PG5 | Gms-Gms-Gm-Gm-Um-Uf-Um-Uf-Um-Cf-Um-Um-Gm-Um-Um-Gf-Am-Cm-Am-Am-G5 | 329 | 1 | UmsEVP-Ufs-Gm-Um-Cf-Af-Am-Cm-Am-Am-Gm-Am-Am-Af-Am-Af-Cm-Cm-Cm-Cms-Gms-Cm | 181 | 8 |
| B207S | C207S-DV32PG101 | Gms-Gms-Gm-Gm-Um-Uf-Um-Uf-Um-Cf-Um-Um-Gm-Um-Um-Gf-Am-Cm-Am-Am-G101 | 330 | 1 | UmsEVP-Ufs-Gm-Um-Cf-Af-Am-Cm-Am-Am-Gm-Am-Am-Af-Am-Af-Cm-Cm-Cm-Cms-Gms-Cm | 181 | 8 |
| B207S | C207S-DV32PG103 | Gms-Gms-Gm-Gm-Um-Uf-Um-Uf-Um-Cf-Um-Um-Gm-Um-Um-Gf-Am-Cm-Am-Am-G103 | 331 | 1 | UmsEVP-Ufs-Gm-Um-Cf-Af-Am-Cm-Am-Am-Gm-Am-Am-Af-Am-Af-Cm-Cm-Cm-Cms-Gms-Cm | 181 | 8 |
| B418S | C418S-DV34Pd7BG5 | Cms-Ums-Gm-Cm-Um-Af-Um-Gf-Cm-Cf-Um-Cm-Am-dT-Cm-Uf-Um-Cm-Um-Um-G5 | 350 | 6 | AmsEVP-Afs-Gf-Am-Am-Gf-dA-Um-Gm-Am-Gm-Gm-Cm-Af-Um-Af-Gm-Cm-Am-Gms-Cms-Am | 321 | 13 |
| B418S | C418S-DV34Pd7BG101 | Cms-Ums-Gm-Cm-Um-Af-Um-Gf-Cm-Cf-Um-Cm-Am-dT-Cm-Uf-Um-Cm-Um-Um-G101 | 351 | 6 | AmsEVP-Afs-Gf-Am-Am-Gf-dA-Um-Gm-Am-Gm-Gm-Cm-Af-Um-Af-Gm-Cm-Am-Gms-Cms-Am | 321 | 13 |
| B418S | C418S-DV34Pd7BG103 | Cms-Ums-Gm-Cm-Um-Af-Um-Gf-Cm-Cf-Um-Cm-Am-dT-Cm-Uf-Um-Cm-Um-Um-G103 | 352 | 6 | AmsEVP-Afs-Gf-Am-Am-Gf-dA-Um-Gm-Am-Gm-Gm-Cm-Af-Um-Af-Gm-Cm-Am-Gms-Cms-Am | 321 | 13 |
| APC | VIR-2218-GL | Gms-Ums-Gm-Um-Gf-Cm-Af-Cf-Uf-Um-Cm-Gm-Cm-Um-Um-Cm-Am-Cm-Am-GL | 353 | 45 | Ums-Gfs-Um-Gm-Am-A(gna)-Gm-Cf-Gf-Am-Am-Gm-Um-Gf-Cm-Af-Cm-Am-Cms-Ums-Um | 294 | 79 |
| ANC | CNC-G5 | Gms-Gms-Um-Cm-Um-Cm-Uf-Um-Cf-Um-Af-Um-Cm-Gm-Am-Um-Cm-Um-Um-Am-Um-G5 | 354 | 46 | AmsEVP-Ufs-Am-Af-Gf-Af-Um-Cm-Gm-Am-Um-Am-Gm-Af-Am-Gf-Am-Gm-Am-Cm-Cms-Cms-Am | 295 | 80 |

Preparation of Test Compounds:

The procedure is the same as in Example 7.

Experimental Animal Information:

Species/Strain: AAV-HBV mice

Grade: SPF (Specific Pathogen-Free)

Gender: Male

Quantity: 82

Age: 5 weeks

Weight: 19-24 g

Source: Beijing Vital River Laboratory Animal Technology Co., Ltd.

Production License Number: SCXK (Jing) 2021-0006

Institutional Animal Care and Use Committee (IACUC):

After receipt, the experimental animals were feeded at Beijing Vitalstar Biotechnology Co., Ltd., under the license number: SCXK (Jing) 2022-0013. This project has been reviewed and approved by the Experimental Animal Ethics Committee of Beijing Vitalstar Biotechnology Co., Ltd., with the IACUC number VST-SY-24062701. The experimental procedures were strictly conducted in accordance with IACUC requirements to ensure animal welfare.

Feeding and Management:

The animals were housed in a negative-pressure barrier environment using plastic (polycarbonate) cages (dimensions: 370×157×180 mm) in individually ventilated caging (IVC) systems. Due to the aggressive nature of male animals, they were housed individually. The feeding and management of the animals were the responsibility of Beijing Vitalstar Biotechnology Co., Ltd.

The use and testing of animal feed, bedding, and drinking water complied with the GB14925-2010 "Laboratory Animal—Requirements of Environment and Housing Facilities" standards. Environmental controls for animal feeding, including temperature, humidity, pressure differential, noise, illumination, air exchange rate, and ammonia concentration, were for now implemented in accordance with the GB50447-2008 "Technical Specification for Construction of Laboratory Animal Facilities." The animal room temperature was maintained at 20-26° C. (daily temperature variation≤4° C.), and relative humidity was controlled at 40-70%. Artificial lighting was used to provide a 12/12-hour light/dark cycle. Compressed wood shavings for bedding were purchased from Beijing Ke'ao Xieli Feed Co., Ltd. (Batch No.: 23109613). Rodent growth and breeding feed were purchased from Beijing Ke'ao Xieli Feed Co., Ltd. (Batch No.: 23103313). All records related to animal care, management, and environmental controls during the experimental period were maintained and stored at Beijing Vitalstar Biotechnology Co., Ltd.

2. Experimental Methods 2.1 AAV-HBV Mouse Model Preparation

Definition of experimental timeline: The day of administration of the vehicle or test substance to the animals is defined as Day 0.

One hundred SPF-grade C57BL/6 male mice were acclimatized in a barrier facility for 7 days, with daily observations to confirm their health and absence of abnormalities before model preparation. A persistent HBV-infected mouse model was established by tail vein injection of rAAV8-1.3HBV The AAV virus injection dose was $1.00\times10^{10}$ vg/mouse. The AAV virus was diluted with sterile PBS to a concentration of $5.00\times10^{10}$ vg/mL, and each mouse was injected with 200 μL. Serum levels of HBV DNA, HBeAg, and HBsAg were measured starting 4 weeks after virus injection.

2.2 Animal Grouping and Administration

Definition of experimental timeline: The day of administration of the vehicle or test substance to the animals is defined as Day 0 (D0).

On Day −2, blood was collected from all mice via the submandibular vein to obtain plasma. The collected blood samples were anticoagulated with EDTA, centrifuged at 5000 rpm for 10 minutes, and the supernatant was used for HBV model validation. On Day 0, based on the results from Day −2, 72 animals were selected and divided into 12 groups, with 6 mice in each group. Details on grouping and administration are as shown in Table 70.

TABLE 70

Group settings and administration details

| Group | Administration regimen | Administration route | Number of animals |
|---|---|---|---|
| siRNA (11 groups) | 3 mg/kg, administered on D 0 | s.c. | 6 mice/group × 11 group |
| Vehicle control (1 group) | PBS, administered once on D 0 | s.c. | 6 mice/group × 1 group |

TABLE 70-continued

Note:
s.c. represents subcutaneous injection.

2.3 Observation and Indicator Monitoring (1) General Observation

During both the model preparation and experimental periods, animals were observed daily, and records were maintained. Observations included: mortality, moribund state, feed and water intake, injuries, feces, appearance and coat condition, mental state, and activity levels.

(2) Body Weight

Acclimatization period: Body weights were recorded upon animal receipt and on the final day of the acclimatization period.

Experimental period: Body weights were recorded weekly during the experimental period. If administration or blood collection was scheduled on the same day, weights were measured prior to the procedure or before euthanasia.

(3) Measurement of Serum HBsAg, HBeAg, HBV DNA, and ALT Levels

Blood was collected from all animals via the submandibular vein on Days −2, 6, 13, 20, 27, and 34 to obtain plasma. The collected blood samples were anticoagulated with EDTA, centrifuged at 5000 rpm for 10 minutes, and the serum was separated. After blood collection, the serum was separated, diluted with PBS, and sent for testing. For each sample, 10 μL of serum was diluted to 500 μL with PBS (50-fold dilution) and sent to Beijing Di'an Medical Laboratory Co., Ltd. for the detection of serum HBV DNA, HBeAg, and HBsAg. For each sample, 30 μL of serum was diluted to 120 μL with PBS (4-fold dilution) and sent to Beijing Di'an Medical Laboratory Co., Ltd. for the detection of serum ALT. The remaining plasma was stored at −80° C. for future use.

3. Experimental Results

Figure 4A:
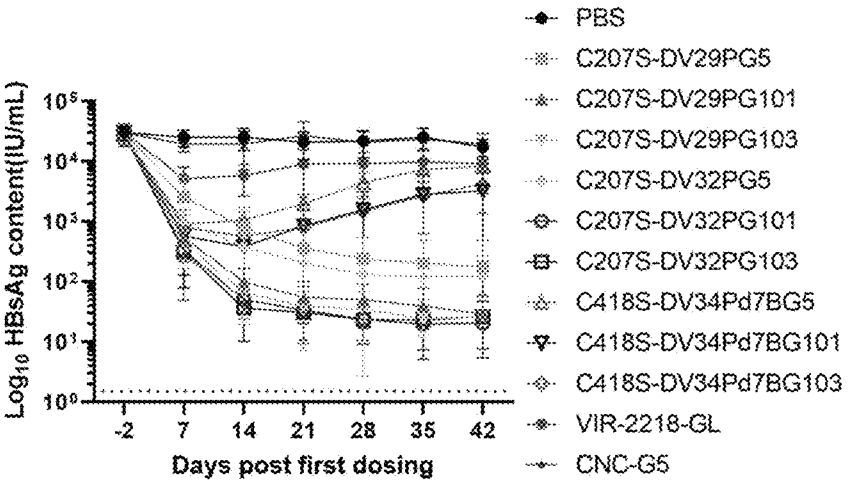
FIG. 4A shows HBsAg levels in AAV-HBV model mice treated with candidate siRNA sequences conjugated to different GalNAc moieties.
Figure 4B:
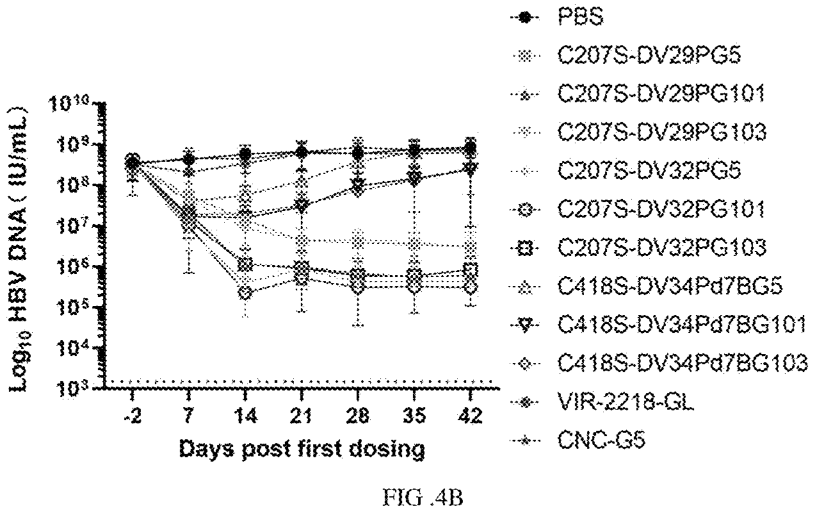
FIG. 4B shows HBV DNA levels in AAV-HBV model mice treated with candidate siRNA sequences conjugated to different GalNAc moieties.
Figure 4C:
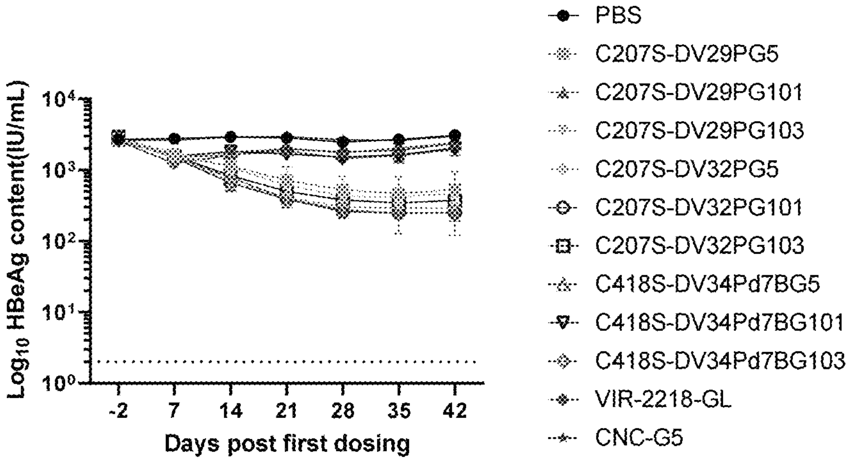
FIG. 4C shows HBeAg levels in AAV-HBV model mice treated with candidate siRNA sequences conjugated to different GalNAc moieties.
Figure 4D:
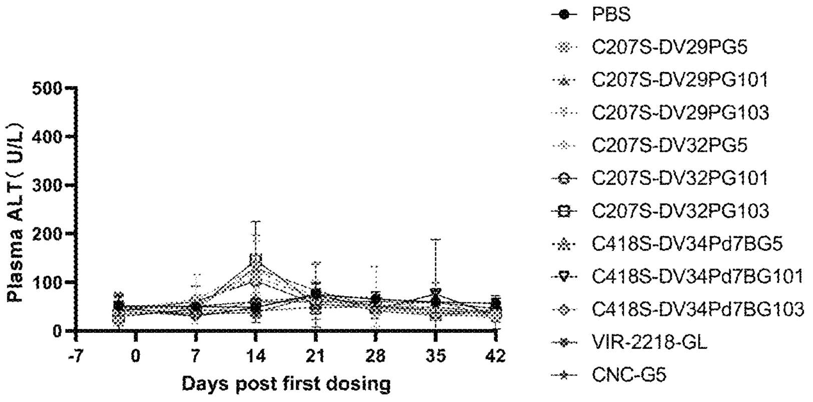
FIG. 4D shows ALT levels in AAV-HBV model mice treated with candidate siRNA sequences conjugated to different GalNAc moieties.
Figure 4E:
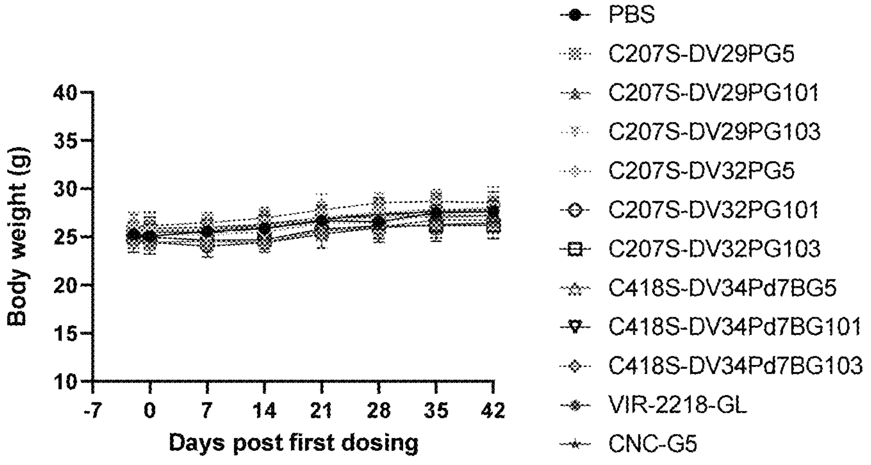
FIG. 4E shows body weight changes in AAV-HBV model mice treated with candidate siRNA sequences conjugated to different GalNAc moieties.

The changes in HBsAg, HBeAg, HBV DNA, ALT levels, and body weight over time for each group of mice are shown in Tables 71-75 and FIGS. 4A-4E. The experimental results indicate that the efficacy of all tested sequences was superior to that of the positive control sequence VIR-2218-GL. Among them, the sequences C207S-DV29PG101, C207S-DV29PG103, C207S-DV32PG101, and C207S-DV32PG103 demonstrated superior efficacy in reducing HBsAg, HBV DNA, and HBeAg levels, significantly outperforming the positive control sequence VIR-2218-GL. By Day 28 post-administration, these sequences still reduced HBsAg by more than 3 log 10 and HBV DNA by more than 3 log 10, with no rebound observed, demonstrating excellent anti-HBV efficacy.

TABLE 71

Changes in plasma HBsAg levels in mice across sequence groups

| Unmodified | | Log10 HBsAg (IU/mL) | | | | | | |
|---|---|---|---|---|---|---|---|---|
| sequence code | Sequence code | D −2 | D 7 | D 14 | D 21 | D 28 | D 35 | D 42 |
| / | PBS | 4.47 ± 0.12 | 4.38 ± 0.15 | 4.36 ± 0.21 | 4.26 ± 0.27 | 4.3 ± 0.21 | 4.37 ± 0.17 | 4.22 ± 0.16 |
| B207S | C207S-DV29PG5 | 4.46 ± 0.13 | 3.11 ± 0.67 | 2.54 ± 0.79 | 2.16 ± 0.8 | 1.94 ± 0.9 | 1.78 ± 0.95 | 1.56 ± 0.98 |

TABLE 71-continued

Changes in plasma HBsAg levels in mice across sequence groups

| Unmodified | | Log10 HBsAg (IU/mL) | | | | | | |
|---|---|---|---|---|---|---|---|---|
| sequence code | Sequence code | D −2 | D 7 | D 14 | D 21 | D 28 | D 35 | D 42 |
| B207S | C207S-DV29PG101 | 4.43 ± 0.16 | 2.65 ± 0.32 | 1.8 ± 0.59 | 1.47 ± 0.7 | 1.44 ± 0.69 | 1.19 ± 0.77 | 1 ± 0.83 |
| B207S | C207S-DV29PG103 | 4.46 ± 0.15 | 2.54 ± 0.37 | 1.66 ± 0.47 | 1.36 ± 0.58 | 1.22 ± 0.71 | 1.04 ± 0.71 | 1.02 ± 0.73 |
| B207S | C207S-DV32PG5 | 4.45 ± 0.15 | 2.86 ± 0.49 | 2.34 ± 0.7 | 2.08 ± 0.66 | 1.88 ± 0.74 | 1.75 ± 0.83 | 1.56 ± 1 |
| B207S | C207S-DV32PG101 | 4.46 ± 0.12 | 2.5 ± 0.2 | 1.66 ± 0.22 | 1.47 ± 0.31 | 1.27 ± 0.39 | 1.12 ± 0.51 | 1.19 ± 0.43 |
| B207S | C207S-DV32PG103 | 4.42 ± 0.22 | 2.25 ± 0.64 | 1.33 ± 0.64 | 1.3 ± 0.59 | 1.21 ± 0.53 | 1.18 ± 0.55 | 1.18 ± 0.62 |
| B418S | C418S-DV34Pd7BG5 | 4.43 ± 0.15 | 2.92 ± 0.19 | 2.99 ± 0.19 | 3.23 ± 0.31 | 3.58 ± 0.31 | 3.83 ± 0.22 | 3.81 ± 0.42 |
| B418S | C418S-DV34Pd7BG101 | 4.47 ± 0.11 | 2.67 ± 0.28 | 2.35 ± 0.54 | 2.63 ± 0.59 | 2.95 ± 0.57 | 3.21 ± 0.52 | 3.24 ± 0.6 |
| B418S | C418S-DV34Pd7BG103 | 4.46 ± 0.11 | 2.68 ± 0.55 | 2.51 ± 0.56 | 2.69 ± 0.51 | 2.94 ± 0.6 | 3.26 ± 0.46 | 3.52 ± 0.35 |
| APC | VIR-2218-GL | 4.46 ± 0.14 | 3.66 ± 0.24 | 3.71 ± 0.23 | 3.84 ± 0.37 | 3.86 ± 0.39 | 3.87 ± 0.41 | 3.82 ± 0.45 |
| ANC | CNC-G5 | 4.44 ± 0.21 | 4.27 ± 0.13 | 4.21 ± 0.3 | 4.33 ± 0.32 | 4.25 ± 0.3 | 4.26 ± 0.4 | 4.22 ± 0.33 |

TABLE 72

Changes in plasma HBV DNA levels in mice across sequence groups

| Unmodified | | Log10 HBV DNA (IU/mL) | | | | | | |
|---|---|---|---|---|---|---|---|---|
| sequence code | Sequence code | D −2 | D 7 | D 14 | D 21 | D 28 | D 35 | D 42 |
| / | PBS | 8.47 ± 0.27 | 8.58 ± 0.21 | 8.68 ± 0.28 | 8.71 ± 0.38 | 8.57 ± 0.53 | 8.73 ± 0.46 | 8.7 ± 0.64 |
| B207S | C207S-DV29PG5 | 8.47 ± 0.23 | 7.46 ± 0.67 | 6.74 ± 0.97 | 6.32 ± 0.77 | 5.97 ± 1.43 | 6.01 ± 1.09 | 5.69 ± 1.16 |
| B207S | C207S-DV29PG101 | 8.5 ± 0.17 | 7.21 ± 0.32 | 5.78 ± 0.51 | 5.53 ± 0.85 | 5.3 ± 0.94 | 5.33 ± 0.69 | 4.91 ± 1.22 |
| B207S | C207S-DV29PG103 | 8.51 ± 0.25 | 6.8 ± 0.32 | 5.41 ± 0.51 | 5.48 ± 0.8 | 4.97 ± 1.14 | 4.98 ± 1.17 | 5.09 ± 1.09 |
| B207S | C207S-DV32PG5 | 8.49 ± 0.21 | 7.5 ± 0.5 | 6.7 ± 0.74 | 6.24 ± 0.88 | 6.39 ± 0.78 | 6.29 ± 0.8 | 6.15 ± 0.78 |
| B207S | C207S-DV32PG101 | 8.47 ± 0.27 | 6.88 ± 0.47 | 5.1 ± 0.5 | 5.3 ± 1.07 | 5.06 ± 1 | 5.24 ± 0.7 | 5.29 ± 0.61 |
| B207S | C207S-DV32PG103 | 8.49 ± 0.28 | 6.84 ± 0.64 | 5.64 ± 0.73 | 5.31 ± 0.91 | 5.41 ± 0.67 | 5.25 ± 1.1 | 5.51 ± 0.86 |
| B418S | C418S-DV34Pd7BG5 | 8.5 ± 0.15 | 7.57 ± 0.18 | 7.68 ± 0.26 | 8.02 ± 0.34 | 8.48 ± 0.37 | 8.77 ± 0.22 | 8.78 ± 0.47 |
| B418S | C418S-DV34Pd7BG101 | 8.53 ± 0.12 | 7.17 ± 0.27 | 6.89 ± 0.69 | 7.12 ± 0.73 | 7.66 ± 0.67 | 7.94 ± 05 | 8.07 ± 0.68 |
| B418S | C418S-DV34Pd7BG | 8.53 ± 0.2 | 7.13 ± 0.44 | 7.01 ± 0.58 | 7.18 ± 0.66 | 7.56 ± 0.65 | 7.94 ± 0.47 | 8.29 ± 0.38 |
| APC | VIR-2218-GL | 8.42 ± 0.3 | 8.24 ± 0.27 | 8.43 ± 0.31 | 8.62 ± 0.41 | 8.57 ± 0.47 | 8.49 ± 0.66 | 8.57 ± 0.57 |
| ANC | CNC-G5 | 8.43 ± 0.29 | 8.58 ± 0.29 | 8.55 ± 0.29 | 8.76 ± 0.21 | 8.83 ± 0.31 | 8.72 ± 0.41 | 8.79 ± 0.33 |

TABLE 73

Changes in plasma HBeAg levels in mice across sequence groups

| Unmodified | | Log10 HBeAg (IU/mL) | | | | | | |
|---|---|---|---|---|---|---|---|---|
| sequence code | Sequence code | D −2 | D 7 | D 14 | D 21 | D 28 | D 35 | D 42 |
| / | PBS | 3.43 ± 0.06 | 3.44 ± 0.02 | 3.46 ± 0.03 | 3.45 ± 0.03 | 3.39 ± 0.06 | 3.43 ± 0.04 | 3.49 ± 0.03 |

TABLE 73-continued

Changes in plasma HBeAg levels in mice across sequence groups

| Unmodified sequence code | Sequence code | Log10 HBeAg (IU/mL) D −2 | D 7 | D 14 | D 21 | D 28 | D 35 | D 42 |
|---|---|---|---|---|---|---|---|---|
| B207S | C207S-DV29PG5 | 3.42 ± 0.03 | 3.18 ± 0.1 | 3.04 ± 0.17 | 2.81 ± 0.21 | 2.67 ± 0.24 | 2.59 ± 0.27 | 2.65 ± 0.28 |
| B207S | C207S-DV29PG101 | 3.43 ± 0.02 | 3.18 ± 0.04 | 2.87 ± 0.14 | 2.58 ± 0.11 | 2.43 ± 0.1 | 2.39 ± 0.07 | 2.39 ± 0.1 |
| B207S | C207S-DV29PG103 | 3.44 ± 0.04 | 3.22 ± 0.06 | 2.82 ± 0.08 | 2.61 ± 0.08 | 2.47 ± 0.1 | 2.46 ± 0.06 | 2.45 ± 0.06 |
| B207S | C207S-DV32PG5 | 3.44 ± 0.03 | 3.24 ± 0.04 | 3.03 ± 0.09 | 2.77 ± 0.14 | 2.63 ± 0.12 | 2.6 ± 0.14 | 2.65 ± 0.15 |
| B207S | C207S-DV32PG101 | 3.44 ± 0.03 | 3.17 ± 0.06 | 2.81 ± 0.1 | 2.58 ± 0.07 | 2.42 ± 0.06 | 2.39 ± 0.06 | 2.4 ± 0.06 |
| B207S | C207S-DV32PG103 | 3.46 ± 0.03 | 3.19 ± 0.07 | 2.91 ± 0.1 | 2.69 ± 0.13 | 2.57 ± 0.12 | 2.52 ± 0.13 | 2.56 ± 0.12 |
| B418S | C418S-DV34Pd7BG5 | 3.43 ± 0.03 | 3.18 ± 0.09 | 3.25 ± 0.06 | 3.3 ± 0.04 | 3.24 ± 0.06 | 3.3 ± 0.06 | 3.38 ± 0.04 |
| B418S | C418S-DV34Pd7BG101 | 3.41 ± 0.05 | 3.19 ± 0.07 | 3.25 ± 0.09 | 3.22 ± 0.07 | 3.18 ± 0.07 | 3.2 ± 0.08 | 3.3 ± 0.06 |
| B418S | C418S-DV34Pd7BG | 3.43 ± 0.02 | 3.17 ± 0.03 | 3.21 ± 0.04 | 3.26 ± 0.06 | 3.16 ± 0.08 | 3.19 ± 0.1 | 3.28 ± 0.08 |
| APC | VIR-2218-GL | 3.4 ± 0.07 | 3.09 ± 0.07 | 3.2 ± 0.09 | 3.29 ± 0.05 | 3.25 ± 0.08 | 3.27 ± 0.1 | 3.35 ± 0.17 |
| ANC | CNC-G5 | 3.42 ± 0.03 | 3.42 ± 0.04 | 3.46 ± 0.05 | 3.47 ± 0.04 | 3.42 ± 0.05 | 3.41 ± 0.05 | 3.47 ± 0.04 |

TABLE 74

Changes in plasma ALT levels in mice across sequence groups

| Unmodified sequence code | Sequence code | ALT (U/L) D 7 | D 14 | D 21 | D 28 | D 35 | D 42 |
|---|---|---|---|---|---|---|---|
| B207S | C207S-DV29PG5 | 30 | 53 | 111 | 68 | 71 | 41 |
| | C207S-DV29PG101 | 50 | 45 | 129 | 83 | 50 | 61 |
| | C207S-DV29PG103 | 44 | 63 | 129 | 57 | 49 | 35 |
| | C207S-DV32PG5 | 51 | 49 | 122 | 71 | 43 | 40 |
| | C207S-DV32PG101 | 41 | 61 | 103 | 61 | 48 | 43 |
| | C207S-DV32PG103 | 29 | 45 | 146 | 56 | 49 | 33 |

TABLE 74-continued

Changes in plasma ALT levels in mice across sequence groups

| Unmodified sequence code | Sequence code | ALT (U/L) D 7 | D 14 | D 21 | D 28 | D 35 | D 42 |
|---|---|---|---|---|---|---|---|
| B418S | C418S-DV34Pd7BG5 | 34 | 49 | 41 | 48 | 49 | 36 |
| | C418S-DV34Pd7BG101 | 48 | 30 | 48 | 75 | 44 | 76 |
| | C418S-DV34Pd7BG103 | 42 | 30 | 62 | 69 | 41 | 32 |
| APC | VIR-2218-GL | 47 | 35 | 37 | 79 | 50 | 49 |
| CNC | CNC-G5 | 48 | 51 | 60 | 60 | 61 | 58 |
| | PBS | 51 | 53 | 49 | 75 | 65 | 59 |

TABLE 75

Changes in body weight of mice across sequence groups

| Unmodified sequence code | Sequence code | Body weight (g) D 7 | D 14 | D 21 | D 28 | D 35 | D 42 |
|---|---|---|---|---|---|---|---|
| B207S | C207S-DV29PG5 | 25.8 | 25.6 | 25.6 | 26 | 27.0 | 27.5 |
| | C207S-DV29PG101 | 24.8 | 24.4 | 24.5 | 24.4 | 25.6 | 26.0 |
| | C207S-DV29PG103 | 25.7 | 25.4 | 25.2 | 25.5 | 26.6 | 27.0 |
| | C207S-DV32PG5 | 25.6 | 25.7 | 25.7 | 25.5 | 26.4 | 26.4 |
| | C207S-DV32PG101 | 24.6 | 24.4 | 24.1 | 24.4 | 25.3 | 26.0 |
| | C207S-DV32PG103 | 25 | 25 | 24.6 | 24.7 | 25.8 | 26.1 |
| B418S | C418S-DV34Pd7BG5 | 25.6 | 25.7 | 25.8 | 26.2 | 26.6 | 27.1 |
| | C418S-DV34Pd7BG101 | 25.4 | 25.6 | 25.4 | 25.9 | 26.8 | 27.4 |
| | C418S-DV34Pd7BG103 | 26.1 | 26.2 | 26.5 | 27 | 27.8 | 28.5 |
| APC | VIR-2218-GL | 25.5 | 25.9 | 26 | 26.3 | 27.0 | 27.3 |
| CNC | CNC-G5 | 25.4 | 25.5 | 25.5 | 26.4 | 26.9 | 27.1 |
| | PBS | 25.3 | 25.1 | 25.6 | 25.9 | 26.7 | 26.6 |

SEQUENCE LISTING (354 sequences)

SEQ ID NO: 1 - RNA, 20 nt, synthetic construct
  source 1..20: mol_type = other RNA
ggggtttttcttgttgacaa

SEQ ID NO: 2 - RNA, 21 nt, synthetic construct
  source 1..21: mol_type = other RNA
cccgtctgtgccttctcatct

SEQ ID NO: 3 - RNA, 21 nt, synthetic construct
  source 1..21: mol_type = other RNA
ccggaccgtgtgcacttcgct

SEQ ID NO: 4 - RNA, 21 nt, synthetic construct
  source 1..21: mol_type = other RNA
gaccgtgtgcacttcgcttca

SEQ ID NO: 5 - RNA, 21 nt, synthetic construct
  source 1..21: mol_type = other RNA
cggaccgtgtgcacttcgctt

SEQ ID NO: 6 - RNA, 20 nt, synthetic construct
  source 1..20: mol_type = other RNA
ctgctatgcctcatcttctt

SEQ ID NO: 7 - RNA, 21 nt, synthetic construct
  source 1..21: mol_type = other RNA
tgctgctatgcctcatcttct

SEQ ID NO: 8 - RNA, 22 nt, synthetic construct
  source 1..22: mol_type = other RNA
ttgtcaacaagaaaaaccccgc

SEQ ID NO: 9 - RNA, 23 nt, synthetic construct
  source 1..23: mol_type = other RNA
agatgagaaggcacagacgggga

SEQ ID NO: 10 - RNA, 23 nt, synthetic construct
  source 1..23: mol_type = other RNA
agcgaagtgcacacggtccggca

SEQ ID NO: 11 - RNA, 23 nt, synthetic construct
  source 1..23: mol_type = other RNA
tgaagcgaagtgcacacggtccg

SEQ ID NO: 12 - RNA, 23 nt, synthetic construct
  source 1..23: mol_type = other RNA
aagcgaagtgcacacggtccggc

SEQ ID NO: 13 - RNA, 22 nt, synthetic construct
  source 1..22: mol_type = other RNA
aagaagatgaggcatagcagca

SEQ ID NO: 14 - RNA, 23 nt, synthetic construct
  source 1..23: mol_type = other RNA
agaagatgaggcatagcagcagg

SEQ ID NO: 15 - RNA, 21 nt, synthetic construct
  source 1..21: mol_type = other RNA
tcgtgttacaggcggggtttt

SEQ ID NO: 16 - RNA, 21 nt, synthetic construct
  source 1..21: mol_type = other RNA
tacaggcggggtttttcttgt

SEQ ID NO: 17 - RNA, 21 nt, synthetic construct
  source 1..21: mol_type = other RNA
aggcggggtttttcttgttga

SEQ ID NO: 18 - RNA, 21 nt, synthetic construct
  source 1..21: mol_type = other RNA
gcggggtttttcttgttgaca

SEQ ID NO: 19 - RNA, 21 nt, synthetic construct
  source 1..21: mol_type = other RNA
cggggtttttcttgttgacaa

SEQ ID NO: 20 - RNA, 21 nt, synthetic construct
  source 1..21: mol_type = other RNA
gtctagactcgtggtggactt

SEQ ID NO: 21 - RNA, 21 nt, synthetic construct
  source 1..21: mol_type = other RNA
ctcgtggtggacttctctcaa

SEQ ID NO: 22 - RNA, 21 nt, synthetic construct
  source 1..21: mol_type = other RNA
tcgtggtggacttctctcaat

SEQ ID NO: 23 - RNA, 21 nt, synthetic construct
  source 1..21: mol_type = other RNA
gtggtggacttctctcaattt

SEQ ID NO: 24 - RNA, 21 nt, synthetic construct
  source 1..21: mol_type = other RNA
tggtggacttctctcaatttt

SEQ ID NO: 25 - RNA, 21 nt, synthetic construct
  source 1..21: mol_type = other RNA
gtggacttctctcaattttct

SEQ ID NO: 26 - RNA, 21 nt, synthetic construct
  source 1..21: mol_type = other RNA
gtgtctgcggcgttttatcat

SEQ ID NO: 27 - RNA, 21 nt, synthetic construct
  source 1..21: mol_type = other RNA
tcctgctgctatgcctcatct

SEQ ID NO: 28 - RNA, 21 nt, synthetic construct
  source 1..21: mol_type = other RNA
atgttgcccgtttgtcctcta

SEQ ID NO: 29 - RNA, 21 nt, synthetic construct
  source 1..21: mol_type = other RNA
ctgctcaaggaacctctatgt

SEQ ID NO: 30 - RNA, 21 nt, synthetic construct
  source 1..21: mol_type = other RNA
tagggctttcccccactgttt

SEQ ID NO: 31 - RNA, 21 nt, synthetic construct
  source 1..21: mol_type = other RNA
cagttatatggatgatgtggt

SEQ ID NO: 32 - RNA, 21 nt, synthetic construct
  source 1..21: mol_type = other RNA
ctgccgatccatactgcggaa

SEQ ID NO: 33 - RNA, 21 nt, synthetic construct
  source 1..21: mol_type = other RNA
atccatactgcggaactccta

SEQ ID NO: 34 - RNA, 21 nt, synthetic construct
  source 1..21: mol_type = other RNA
accacggggcgcacctctctt

SEQ ID NO: 35 - RNA, 21 nt, synthetic construct
  source 1..21: mol_type = other RNA
cacggggcgcacctctcttta

SEQ ID NO: 36 - RNA, 21 nt, synthetic construct
  source 1..21: mol_type = other RNA
ctccccgtctgtgccttctca

SEQ ID NO: 37 - RNA, 21 nt, synthetic construct
  source 1..21: mol_type = other RNA
tccccgtctgtgccttctcat

SEQ ID NO: 38 - RNA, 21 nt, synthetic construct
  source 1..21: mol_type = other RNA
gggtttttcttgttgacaaga

SEQ ID NO: 39 - RNA, 21 nt, synthetic construct
  source 1..21: mol_type = other RNA
tggacttctctcaattttcta

SEQ ID NO: 40 - RNA, 21 nt, synthetic construct
  source 1..21: mol_type = other RNA
gacttctctcaattttctaga

SEQ ID NO: 41 - RNA, 21 nt, synthetic construct
  source 1..21: mol_type = other RNA
tgtgccttctcatctgccgga

SEQ ID NO: 42 - RNA, 21 nt, synthetic construct
  source 1..21: mol_type = other RNA
ccttctcatctgccggaccgt

SEQ ID NO: 43 - RNA, 20 nt, synthetic construct
  source 1..20: mol_type = other RNA
tgctgctatgcctcatctta

SEQ ID NO: 44 - RNA, 21 nt, synthetic construct
  source 1..21: mol_type = other RNA
ccgtctgtgccttctcatcta

SEQ ID NO: 45 - RNA, 19 nt, synthetic construct
  source 1..19: mol_type = other RNA
gtgtgcacttcgcttcaca

SEQ ID NO: 46 - RNA, 21 nt, synthetic construct
  source 1..21: mol_type = other RNA
ggtctcttctatcgatcttat

SEQ ID NO: 47 - RNA, 23 nt, synthetic construct
  source 1..23: mol_type = other RNA
aaaaccccgcctgtaacacgaga

SEQ ID NO: 48 - RNA, 23 nt, synthetic construct
  source 1..23: mol_type = other RNA
acaagaaaaaccccgcctgtaac

SEQ ID NO: 49 - RNA, 23 nt, synthetic construct
  source 1..23: mol_type = other RNA
tcaacaagaaaaaccccgcctgt

SEQ ID NO: 50 - RNA, 23 nt, synthetic construct
  source 1..23: mol_type = other RNA
tgtcaacaagaaaaaccccgcct

SEQ ID NO: 51 - RNA, 23 nt, synthetic construct
  source 1..23: mol_type = other RNA
ttgtcaacaagaaaaaccccgcc

SEQ ID NO: 52 - RNA, 23 nt, synthetic construct
  source 1..23: mol_type = other RNA
aagtccaccacgagtctagactc

SEQ ID NO: 53 - RNA, 23 nt, synthetic construct
  source 1..23: mol_type = other RNA
ttgagagaagtccaccacgagtc

SEQ ID NO: 54 - RNA, 23 nt, synthetic construct
  source 1..23: mol_type = other RNA
attgagagaagtccaccacgagt

SEQ ID NO: 55 - RNA, 23 nt, synthetic construct
  source 1..23: mol_type = other RNA
aaattgagagaagtccaccacga

SEQ ID NO: 56 - RNA, 23 nt, synthetic construct
  source 1..23: mol_type = other RNA
aaaattgagagaagtccaccacg

SEQ ID NO: 57 - RNA, 23 nt, synthetic construct
  source 1..23: mol_type = other RNA
agaaaattgagagaagtccacca

SEQ ID NO: 58 - RNA, 23 nt, synthetic construct
  source 1..23: mol_type = other RNA
atgataaaacgccgcagacacat

SEQ ID NO: 59 - RNA, 23 nt, synthetic construct
  source 1..23: mol_type = other RNA
agatgaggcatagcagcaggatg

SEQ ID NO: 60 - RNA, 23 nt, synthetic construct
  source 1..23: mol_type = other RNA
tagaggacaaacgggcaacatac

SEQ ID NO: 61 - RNA, 23 nt, synthetic construct
  source 1..23: mol_type = other RNA
acatagaggttccttgagcagta

SEQ ID NO: 62 - RNA, 23 nt, synthetic construct
  source 1..23: mol_type = other RNA
aaacagtgggggaaagccctacg

SEQ ID NO: 63 - RNA, 23 nt, synthetic construct
  source 1..23: mol_type = other RNA
accacatcatccatataactgaa

SEQ ID NO: 64 - RNA, 23 nt, synthetic construct
  source 1..23: mol_type = other RNA
ttccgcagtatggatcggcagag

SEQ ID NO: 65 - RNA, 23 nt, synthetic construct
  source 1..23: mol_type = other RNA
taggagttccgcagtatggatcg

SEQ ID NO: 66 - RNA, 23 nt, synthetic construct
  source 1..23: mol_type = other RNA
aagagaggtgcgccccgtggtcg

SEQ ID NO: 67 - RNA, 23 nt, synthetic construct
  source 1..23: mol_type = other RNA
taaagagaggtgcgccccgtggt

SEQ ID NO: 68 - RNA, 23 nt, synthetic construct
  source 1..23: mol_type = other RNA
tgagaaggcacagacggggagtc

SEQ ID NO: 69 - RNA, 23 nt, synthetic construct
  source 1..23: mol_type = other RNA
atgagaaggcacagacggggagt

SEQ ID NO: 70 - RNA, 23 nt, synthetic construct
  source 1..23: mol_type = other RNA
tcttgtcaacaagaaaaaccccg

SEQ ID NO: 71 - RNA, 23 nt, synthetic construct
  source 1..23: mol_type = other RNA
tagaaaattgagagaagtccacg

SEQ ID NO: 72 - RNA, 23 nt, synthetic construct
  source 1..23: mol_type = other RNA
tctagaaaattgagagaagtcca

SEQ ID NO: 73 - RNA, 23 nt, synthetic construct
  source 1..23: mol_type = other RNA
tccggcagatgagaaggcacaga

SEQ ID NO: 74 - RNA, 23 nt, synthetic construct
  source 1..23: mol_type = other RNA
acggtccggcagatgagaaggca

SEQ ID NO: 75 - RNA, 22 nt, synthetic construct
  source 1..22: mol_type = other RNA
taagatgaggcatagcagcagg

SEQ ID NO: 76 - RNA, 21 nt, synthetic construct
  source 1..21: mol_type = other RNA
ttgtcaacaagaaaaaccccg

SEQ ID NO: 77 - RNA, 21 nt, synthetic construct
  source 1..21: mol_type = other RNA
atgaggcatagcagcaggatt

SEQ ID NO: 78 - RNA, 23 nt, synthetic construct
  source 1..23: mol_type = other RNA
tagatgagaaggcacagacgggg

SEQ ID NO: 79 - RNA, 21 nt, synthetic construct
  source 1..21: mol_type = other RNA
tgtgaagcgaagtgcacactt

SEQ ID NO: 80 - RNA, 23 nt, synthetic construct
  source 1..23: mol_type = other RNA
ataagatcgatagaagagaccca

SEQ ID NO: 81 - RNA, 20 nt, synthetic construct
  source 1..20: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'- fluoro
  modified_base 9: mod_base = OTHER; note = 2'-O- methyl
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
ggggtttttcttgttgacaa

SEQ ID NO: 82 - RNA, 20 nt, synthetic construct
  source 1..20: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'- fluoro
  modified_base 9: mod_base = OTHER; note = 2'- fluoro
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
ggggtttttcttgttgacaa

SEQ ID NO: 83 - RNA, 20 nt, synthetic construct
  source 1..20: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'- fluoro
  modified_base 9: mod_base = OTHER; note = 2'- fluoro
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
ggggtttttcttgttgacaa

SEQ ID NO: 84 - RNA, 20 nt, synthetic construct
  source 1..20: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'- fluoro
  modified_base 9: mod_base = OTHER; note = 2'- fluoro
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
ggggtttttcttgttgacaa

SEQ ID NO: 85 - RNA, 20 nt, synthetic construct
  source 1..20: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'- fluoro
  modified_base 9: mod_base = OTHER; note = 2'- fluoro
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'- fluoro
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
ggggtttttcttgttgacaa

SEQ ID NO: 86 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
cccgtctgtgccttctcatct

SEQ ID NO: 87 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
cccgtctgtgccttctcatct

SEQ ID NO: 88 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
cccgtctgtgccttctcatct

SEQ ID NO: 89 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
cccgtctgtgccttctcatct

SEQ ID NO: 90 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'- fluoro
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
cccgtctgtgccttctcatct

SEQ ID NO: 91 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
ccggaccgtgtgcacttcgct

SEQ ID NO: 92 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
ccggaccgtgtgcacttcgct

SEQ ID NO: 93 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
ccggaccgtgtgcacttcgct

SEQ ID NO: 94 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
ccggaccgtgtgcacttcgct

SEQ ID NO: 95 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'- fluoro
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
ccggaccgtgtgcacttcgct

SEQ ID NO: 96 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
gaccgtgtgcacttcgcttca

SEQ ID NO: 97 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
gaccgtgtgcacttcgcttca

SEQ ID NO: 98 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
gaccgtgtgcacttcgcttca

SEQ ID NO: 99 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
gaccgtgtgcacttcgcttca

SEQ ID NO: 100 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'- fluoro
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
gaccgtgtgcacttcgcttca

SEQ ID NO: 101 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
cggaccgtgtgcacttcgctt

SEQ ID NO: 102 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
cggaccgtgtgcacttcgctt

SEQ ID NO: 103 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
cggaccgtgtgcacttcgctt

SEQ ID NO: 104 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
cggaccgtgtgcacttcgctt

SEQ ID NO: 105 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'- fluoro
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
cggaccgtgtgcacttcgctt

SEQ ID NO: 106 - RNA, 20 nt, synthetic construct
  source 1..20: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'- fluoro
  modified_base 9: mod_base = OTHER; note = 2'-O- methyl
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
ctgctatgcctcatcttctt

SEQ ID NO: 107 - RNA, 20 nt, synthetic construct
  source 1..20: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'- fluoro
  modified_base 9: mod_base = OTHER; note = 2'- fluoro
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
ctgctatgcctcatcttctt

SEQ ID NO: 108 - RNA, 20 nt, synthetic construct
  source 1..20: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'- fluoro
  modified_base 9: mod_base = OTHER; note = 2'- fluoro
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
ctgctatgcctcatcttctt

SEQ ID NO: 109 - RNA, 20 nt, synthetic construct
  source 1..20: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'- fluoro
  modified_base 9: mod_base = OTHER; note = 2'- fluoro
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
ctgctatgcctcatcttctt

SEQ ID NO: 110 - RNA, 20 nt, synthetic construct
  source 1..20: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'- fluoro
  modified_base 9: mod_base = OTHER; note = 2'- fluoro
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'- fluoro
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
ctgctatgcctcatcttctt

SEQ ID NO: 111 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
tgctgctatgcctcatcttct

SEQ ID NO: 112 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
tgctgctatgcctcatcttct

SEQ ID NO: 113 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
tgctgctatgcctcatcttct

SEQ ID NO: 114 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
tgctgctatgcctcatcttct

SEQ ID NO: 115 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'- fluoro
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
tgctgctatgcctcatcttct

SEQ ID NO: 116 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
gcggggtttttcttgttgaca

SEQ ID NO: 117 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
gcggggtttttcttgttgaca

SEQ ID NO: 118 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
gcggggtttttcttgttgaca

SEQ ID NO: 119 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
gcggggtttttcttgttgaca

SEQ ID NO: 120 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'- fluoro
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
gcggggtttttcttgttgaca

SEQ ID NO: 121 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
gggtttttcttgttgacaaga

SEQ ID NO: 122 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
gggtttttcttgttgacaaga

SEQ ID NO: 123 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
gggtttttcttgttgacaaga

SEQ ID NO: 124 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
gggtttttcttgttgacaaga

SEQ ID NO: 125 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'- fluoro
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
gggtttttcttgttgacaaga

SEQ ID NO: 126 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
gtggacttctctcaattttct

SEQ ID NO: 127 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
gtggacttctctcaattttct

SEQ ID NO: 128 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
gtggacttctctcaattttct

SEQ ID NO: 129 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
gtggacttctctcaattttct

SEQ ID NO: 130 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'- fluoro
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
gtggacttctctcaattttct

SEQ ID NO: 131 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
tggacttctctcaattttcta

SEQ ID NO: 132 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
tggacttctctcaattttcta

SEQ ID NO: 133 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
tggacttctctcaattttcta

SEQ ID NO: 134 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
tggacttctctcaattttcta

SEQ ID NO: 135 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'- fluoro
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
tggacttctctcaattttcta

SEQ ID NO: 136 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
gacttctctcaattttctaga

SEQ ID NO: 137 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
gacttctctcaattttctaga

SEQ ID NO: 138 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
gacttctctcaattttctaga

SEQ ID NO: 139 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
gacttctctcaattttctaga

SEQ ID NO: 140 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'- fluoro
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
gacttctctcaattttctaga

SEQ ID NO: 141 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
tgtgccttctcatctgccgga

SEQ ID NO: 142 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
tgtgccttctcatctgccgga

SEQ ID NO: 143 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
tgtgccttctcatctgccgga

SEQ ID NO: 144 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
tgtgccttctcatctgccgga

SEQ ID NO: 145 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'- fluoro
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
tgtgccttctcatctgccgga

SEQ ID NO: 146 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
ccttctcatctgccggaccgt

SEQ ID NO: 147 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
ccttctcatctgccggaccgt

SEQ ID NO: 148 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
ccttctcatctgccggaccgt

SEQ ID NO: 149 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
ccttctcatctgccggaccgt

SEQ ID NO: 150 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'- fluoro
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
ccttctcatctgccggaccgt

SEQ ID NO: 151 - RNA, 20 nt, synthetic construct
  source 1..20: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'- fluoro
  modified_base 9: mod_base = OTHER; note = 2'-O- methyl
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
tgctgctatgcctcatctta

SEQ ID NO: 152 - RNA, 20 nt, synthetic construct
  source 1..20: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'- fluoro
  modified_base 9: mod_base = OTHER; note = 2'- fluoro
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
tgctgctatgcctcatctta

SEQ ID NO: 153 - RNA, 20 nt, synthetic construct
  source 1..20: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'- fluoro
  modified_base 9: mod_base = OTHER; note = 2'- fluoro
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
tgctgctatgcctcatctta

SEQ ID NO: 154 - RNA, 20 nt, synthetic construct
  source 1..20: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'- fluoro
  modified_base 9: mod_base = OTHER; note = 2'- fluoro
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
tgctgctatgcctcatctta

SEQ ID NO: 155 - RNA, 20 nt, synthetic construct
  source 1..20: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'- fluoro
  modified_base 9: mod_base = OTHER; note = 2'- fluoro
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'- fluoro
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
tgctgctatgcctcatctta

SEQ ID NO: 156 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
tcgtgttacaggcggggtttt

SEQ ID NO: 157 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
tacaggcggggtttttcttgt

SEQ ID NO: 158 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
aggcggggtttttcttgttga

SEQ ID NO: 159 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
cggggtttttcttgttgacaa

SEQ ID NO: 160 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
gtctagactcgtggtggactt

SEQ ID NO: 161 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
ctcgtggtggacttctctcaa

SEQ ID NO: 162 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
tcgtggtggacttctctcaat

SEQ ID NO: 163 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
gtggtggacttctctcaattt

SEQ ID NO: 164 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
tggtggacttctctcaatttt

SEQ ID NO: 165 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
gtgtctgcggcgttttatcat

SEQ ID NO: 166 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
tcctgctgctatgcctcatct

SEQ ID NO: 167 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
atgttgcccgtttgtcctcta

SEQ ID NO: 168 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
ctgctcaaggaacctctatgt

SEQ ID NO: 169 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
tagggctttcccccactgttt

SEQ ID NO: 170 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
cagttatatggatgatgtggt

SEQ ID NO: 171 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
ctgccgatccatactgcggaa

SEQ ID NO: 172 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
atccatactgcggaactccta

SEQ ID NO: 173 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
accacggggcgcacctctctt

SEQ ID NO: 174 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
cacggggcgcacctctcttta

SEQ ID NO: 175 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
ctccccgtctgtgccttctca

SEQ ID NO: 176 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
tccccgtctgtgccttctcat

SEQ ID NO: 177 - RNA, 19 nt, synthetic construct
  source 1..19: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'- fluoro
  modified_base 6: mod_base = OTHER; note = 2'-O- methyl
  modified_base 7: mod_base = OTHER; note = 2'- fluoro
  modified_base 8: mod_base = OTHER; note = 2'- fluoro
  modified_base 9: mod_base = OTHER; note = 2'- fluoro
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
gtgtgcacttcgcttcaca

SEQ ID NO: 178 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
ggtctcttctatcgatcttat

SEQ ID NO: 179 - RNA, 22 nt, synthetic construct
  source 1..22: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl, 3'- thiophosphate
  modified_base 21: mod_base = OTHER; note = 2'-O- methyl, 3'- thiophosphate
  modified_base 22: mod_base = OTHER; note = 2'-O- methyl
ttgtcaacaagaaaaaccccgc

SEQ ID NO: 180 - RNA, 22 nt, synthetic construct
  source 1..22: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'- fluoro
  modified_base 4: mod_base = OTHER; note = 2'- fluoro
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl, 3'- thiophosphate
  modified_base 21: mod_base = OTHER; note = 2'-O- methyl, 3'- thiophosphate
  modified_base 22: mod_base = OTHER; note = 2'-O- methyl
ttgtcaacaagaaaaaccccgc

SEQ ID NO: 181 - RNA, 22 nt, synthetic construct
  source 1..22: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl, 3'- thiophosphate
  modified_base 21: mod_base = OTHER; note = 2'-O- methyl, 3'- thiophosphate
  modified_base 22: mod_base = OTHER; note = 2'-O- methyl
ttgtcaacaagaaaaaccccgc

SEQ ID NO: 182 - RNA, 22 nt, synthetic construct
  source 1..22: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'- fluoro
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl, 3'- thiophosphate
  modified_base 21: mod_base = OTHER; note = 2'-O- methyl, 3'- thiophosphate
  modified_base 22: mod_base = OTHER; note = 2'-O- methyl
ttgtcaacaagaaaaaccccgc

SEQ ID NO: 183 - RNA, 22 nt, synthetic construct
  source 1..22: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl, 3'- thiophosphate
  modified_base 21: mod_base = OTHER; note = 2'-O- methyl, 3'- thiophosphate
  modified_base 22: mod_base = OTHER; note = 2'-O- methyl
ttgtcaacaagaaaaaccccgc

SEQ ID NO: 184 - RNA, 22 nt, synthetic construct
  source 1..22: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'- fluoro
  modified_base 4: mod_base = OTHER; note = 2'-O- methyl
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl, 3'- thiophosphate
  modified_base 21: mod_base = OTHER; note = 2'-O- methyl, 3'- thiophosphate
  modified_base 22: mod_base = OTHER; note = 2'-O- methyl
ttgtcaacaagaaaaaccccgc

SEQ ID NO: 185 - RNA, 22 nt, synthetic construct
  source 1..22: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl, 3'- thiophosphate
  modified_base 21: mod_base = OTHER; note = 2'-O- methyl, 3'- thiophosphate
  modified_base 22: mod_base = OTHER; note = 2'-O- methyl
ttgtcaacaagaaaaaccccgc

SEQ ID NO: 186 - RNA, 22 nt, synthetic construct
  source 1..22: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl, 3'- thiophosphate
  modified_base 21: mod_base = OTHER; note = 2'-O- methyl, 3'- thiophosphate
  modified_base 22: mod_base = OTHER; note = 2'-O- methyl
ttgtcaacaagaaaaaccccgc

SEQ ID NO: 187 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
agatgagaaggcacagacgggga

SEQ ID NO: 188 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'- fluoro
  modified_base 4: mod_base = OTHER; note = 2'- fluoro
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
agatgagaaggcacagacgggga

SEQ ID NO: 189 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
agatgagaaggcacagacgggga

SEQ ID NO: 190 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'- fluoro
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
agatgagaaggcacagacgggga

SEQ ID NO: 191 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
agatgagaaggcacagacgggga

SEQ ID NO: 192 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'- fluoro
  modified_base 4: mod_base = OTHER; note = 2'-O- methyl
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
agatgagaaggcacagacgggga

SEQ ID NO: 193 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
agatgagaaggcacagacgggga

SEQ ID NO: 194 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
agatgagaaggcacagacgggga

SEQ ID NO: 195 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
agcgaagtgcacacggtccggca

SEQ ID NO: 196 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'- fluoro
  modified_base 4: mod_base = OTHER; note = 2'- fluoro
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
agcgaagtgcacacggtccggca

SEQ ID NO: 197 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
agcgaagtgcacacggtccggca

SEQ ID NO: 198 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'- fluoro
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
agcgaagtgcacacggtccggca

SEQ ID NO: 199 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
agcgaagtgcacacggtccggca

SEQ ID NO: 200 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
agcgaagtgcacacggtccggca

SEQ ID NO: 201 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tgaagcgaagtgcacacggtccg

SEQ ID NO: 202 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'- fluoro
  modified_base 4: mod_base = OTHER; note = 2'- fluoro
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tgaagcgaagtgcacacggtccg

SEQ ID NO: 203 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tgaagcgaagtgcacacggtccg

SEQ ID NO: 204 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'- fluoro
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tgaagcgaagtgcacacggtccg

SEQ ID NO: 205 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tgaagcgaagtgcacacggtccg

SEQ ID NO: 206 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tgaagcgaagtgcacacggtccg

SEQ ID NO: 207 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
aagcgaagtgcacacggtccggc

SEQ ID NO: 208 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'- fluoro
  modified_base 4: mod_base = OTHER; note = 2'- fluoro
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
aagcgaagtgcacacggtccggc

SEQ ID NO: 209 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
aagcgaagtgcacacggtccggc

SEQ ID NO: 210 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'- fluoro
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
aagcgaagtgcacacggtccggc

SEQ ID NO: 211 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
aagcgaagtgcacacggtccggc

SEQ ID NO: 212 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
aagcgaagtgcacacggtccggc

SEQ ID NO: 213 - RNA, 22 nt, synthetic construct
  source 1..22: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl, 3'- thiophosphate
  modified_base 21: mod_base = OTHER; note = 2'-O- methyl, 3'- thiophosphate
  modified_base 22: mod_base = OTHER; note = 2'-O- methyl
aagaagatgaggcatagcagca

SEQ ID NO: 214 - RNA, 22 nt, synthetic construct
  source 1..22: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'- fluoro
  modified_base 4: mod_base = OTHER; note = 2'- fluoro
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl, 3'- thiophosphate
  modified_base 21: mod_base = OTHER; note = 2'-O- methyl, 3'- thiophosphate
  modified_base 22: mod_base = OTHER; note = 2'-O- methyl
aagaagatgaggcatagcagca

SEQ ID NO: 215 - RNA, 22 nt, synthetic construct
  source 1..22: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl, 3'- thiophosphate
  modified_base 21: mod_base = OTHER; note = 2'-O- methyl, 3'- thiophosphate
  modified_base 22: mod_base = OTHER; note = 2'-O- methyl
aagaagatgaggcatagcagca

SEQ ID NO: 216 - RNA, 22 nt, synthetic construct
  source 1..22: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'- fluoro
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl, 3'- thiophosphate
  modified_base 21: mod_base = OTHER; note = 2'-O- methyl, 3'- thiophosphate
  modified_base 22: mod_base = OTHER; note = 2'-O- methyl
aagaagatgaggcatagcagca

SEQ ID NO: 217 - RNA, 22 nt, synthetic construct
  source 1..22: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl, 3'- thiophosphate
  modified_base 21: mod_base = OTHER; note = 2'-O- methyl, 3'- thiophosphate
  modified_base 22: mod_base = OTHER; note = 2'-O- methyl
aagaagatgaggcatagcagca

SEQ ID NO: 218 - RNA, 22 nt, synthetic construct
  source 1..22: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl, 3'- thiophosphate
  modified_base 21: mod_base = OTHER; note = 2'-O- methyl, 3'- thiophosphate
  modified_base 22: mod_base = OTHER; note = 2'-O- methyl
aagaagatgaggcatagcagca

SEQ ID NO: 219 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
agaagatgaggcatagcagcagg

SEQ ID NO: 220 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'- fluoro
  modified_base 4: mod_base = OTHER; note = 2'- fluoro
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
agaagatgaggcatagcagcagg

SEQ ID NO: 221 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
agaagatgaggcatagcagcagg

SEQ ID NO: 222 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'- fluoro
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
agaagatgaggcatagcagcagg

SEQ ID NO: 223 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
agaagatgaggcatagcagcagg

SEQ ID NO: 224 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
agaagatgaggcatagcagcagg

SEQ ID NO: 225 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tgtcaacaagaaaaaccccgcct

SEQ ID NO: 226 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'- fluoro
  modified_base 4: mod_base = OTHER; note = 2'- fluoro
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tgtcaacaagaaaaaccccgcct

SEQ ID NO: 227 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tgtcaacaagaaaaaccccgcct

SEQ ID NO: 228 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'- fluoro
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tgtcaacaagaaaaaccccgcct

SEQ ID NO: 229 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tgtcaacaagaaaaaccccgcct

SEQ ID NO: 230 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tgtcaacaagaaaaaccccgcct

SEQ ID NO: 231 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tcttgtcaacaagaaaaaccccg

SEQ ID NO: 232 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'- fluoro
  modified_base 4: mod_base = OTHER; note = 2'- fluoro
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tcttgtcaacaagaaaaaccccg

SEQ ID NO: 233 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tcttgtcaacaagaaaaaccccg

SEQ ID NO: 234 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'- fluoro
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tcttgtcaacaagaaaaaccccg

SEQ ID NO: 235 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tcttgtcaacaagaaaaaccccg

SEQ ID NO: 236 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tcttgtcaacaagaaaaaccccg

SEQ ID NO: 237 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
agaaaattgagagaagtccacca

SEQ ID NO: 238 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'- fluoro
  modified_base 4: mod_base = OTHER; note = 2'- fluoro
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
agaaaattgagagaagtccacca

SEQ ID NO: 239 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
agaaaattgagagaagtccacca

SEQ ID NO: 240 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'- fluoro
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
agaaaattgagagaagtccacca

SEQ ID NO: 241 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
agaaaattgagagaagtccacca

SEQ ID NO: 242 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
agaaaattgagagaagtccacca

SEQ ID NO: 243 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tagaaaattgagagaagtccacg

SEQ ID NO: 244 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'- fluoro
  modified_base 4: mod_base = OTHER; note = 2'- fluoro
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tagaaaattgagagaagtccacg

SEQ ID NO: 245 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tagaaaattgagagaagtccacg

SEQ ID NO: 246 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'- fluoro
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tagaaaattgagagaagtccacg

SEQ ID NO: 247 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tagaaaattgagagaagtccacg

SEQ ID NO: 248 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tagaaaattgagagaagtccacg

SEQ ID NO: 249 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tctagaaaattgagagaagtcca

SEQ ID NO: 250 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'- fluoro
  modified_base 4: mod_base = OTHER; note = 2'- fluoro
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tctagaaaattgagagaagtcca

SEQ ID NO: 251 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tctagaaaattgagagaagtcca

SEQ ID NO: 252 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'- fluoro
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tctagaaaattgagagaagtcca

SEQ ID NO: 253 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tctagaaaattgagagaagtcca

SEQ ID NO: 254 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tctagaaaattgagagaagtcca

SEQ ID NO: 255 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tccggcagatgagaaggcacaga

SEQ ID NO: 256 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'- fluoro
  modified_base 4: mod_base = OTHER; note = 2'- fluoro
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tccggcagatgagaaggcacaga

SEQ ID NO: 257 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tccggcagatgagaaggcacaga

SEQ ID NO: 258 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'- fluoro
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tccggcagatgagaaggcacaga

SEQ ID NO: 259 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tccggcagatgagaaggcacaga

SEQ ID NO: 260 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tccggcagatgagaaggcacaga

SEQ ID NO: 261 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
acggtccggcagatgagaaggca

SEQ ID NO: 262 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'- fluoro
  modified_base 4: mod_base = OTHER; note = 2'- fluoro
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
acggtccggcagatgagaaggca

SEQ ID NO: 263 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
acggtccggcagatgagaaggca

SEQ ID NO: 264 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'- fluoro
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
acggtccggcagatgagaaggca

SEQ ID NO: 265 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
acggtccggcagatgagaaggca

SEQ ID NO: 266 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
acggtccggcagatgagaaggca

SEQ ID NO: 267 - RNA, 22 nt, synthetic construct
  source 1..22: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl, 3'- thiophosphate
  modified_base 21: mod_base = OTHER; note = 2'-O- methyl, 3'- thiophosphate
  modified_base 22: mod_base = OTHER; note = 2'-O- methyl
taagatgaggcatagcagcagg

SEQ ID NO: 268 - RNA, 22 nt, synthetic construct
  source 1..22: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'- fluoro
  modified_base 4: mod_base = OTHER; note = 2'- fluoro
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl, 3'- thiophosphate
  modified_base 21: mod_base = OTHER; note = 2'-O- methyl, 3'- thiophosphate
  modified_base 22: mod_base = OTHER; note = 2'-O- methyl
taagatgaggcatagcagcagg

SEQ ID NO: 269 - RNA, 22 nt, synthetic construct
  source 1..22: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl, 3'- thiophosphate
  modified_base 21: mod_base = OTHER; note = 2'-O- methyl, 3'- thiophosphate
  modified_base 22: mod_base = OTHER; note = 2'-O- methyl
taagatgaggcatagcagcagg

SEQ ID NO: 270 - RNA, 22 nt, synthetic construct
  source 1..22: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'- fluoro
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl, 3'- thiophosphate
  modified_base 21: mod_base = OTHER; note = 2'-O- methyl, 3'- thiophosphate
  modified_base 22: mod_base = OTHER; note = 2'-O- methyl
taagatgaggcatagcagcagg

SEQ ID NO: 271 - RNA, 22 nt, synthetic construct
  source 1..22: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl, 3'- thiophosphate
  modified_base 21: mod_base = OTHER; note = 2'-O- methyl, 3'- thiophosphate
  modified_base 22: mod_base = OTHER; note = 2'-O- methyl
taagatgaggcatagcagcagg

SEQ ID NO: 272 - RNA, 22 nt, synthetic construct
  source 1..22: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl, 3'- thiophosphate
  modified_base 21: mod_base = OTHER; note = 2'-O- methyl, 3'- thiophosphate
  modified_base 22: mod_base = OTHER; note = 2'-O- methyl
taagatgaggcatagcagcagg

SEQ ID NO: 273 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
aaaaccccgcctgtaacacgaga

SEQ ID NO: 274 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
acaagaaaaaccccgcctgtaac

SEQ ID NO: 275 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tcaacaagaaaaaccccgcctgt

SEQ ID NO: 276 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
ttgtcaacaagaaaaaccccgcc

SEQ ID NO: 277 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
aagtccaccacgagtctagactc

SEQ ID NO: 278 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
ttgagagaagtccaccacgagtc

SEQ ID NO: 279 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
attgagagaagtccaccacgagt

SEQ ID NO: 280 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
aaattgagagaagtccaccacga

SEQ ID NO: 281 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
aaaattgagagaagtccaccacg

SEQ ID NO: 282 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
atgataaaacgccgcagacacat

SEQ ID NO: 283 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
agatgaggcatagcagcaggatg

SEQ ID NO: 284 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tagaggacaaacgggcaacatac

SEQ ID NO: 285 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
acatagaggttccttgagcagta

SEQ ID NO: 286 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
aaacagtgggggaaagccctacg

SEQ ID NO: 287 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
accacatcatccatataactgaa

SEQ ID NO: 288 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
ttccgcagtatggatcggcagag

SEQ ID NO: 289 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
taggagttccgcagtatggatcg

SEQ ID NO: 290 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
aagagaggtgcgccccgtggtcg

SEQ ID NO: 291 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
taaagagaggtgcgccccgtggt

SEQ ID NO: 292 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
tgagaaggcacagacggggagtc

SEQ ID NO: 293 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
atgagaaggcacagacggggagt

SEQ ID NO: 294 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = Glycerol nucleic acid
  modified_base 7: mod_base = OTHER; note = 2'-O- methyl
  modified_base 8: mod_base = OTHER; note = 2'- fluoro
  modified_base 9: mod_base = OTHER; note = 2'- fluoro
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl, 3'- thiophosphate
  modified_base 20: mod_base = OTHER; note = 2'-O- methyl, 3'- thiophosphate
  modified_base 21: mod_base = OTHER; note = 2'-O- methyl
tgtgaagcgaagtgcacactt

SEQ ID NO: 295 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
ataagatcgatagaagagaccca

SEQ ID NO: 296 - RNA, 20 nt, synthetic construct
  source 1..20: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'- fluoro
  modified_base 9: mod_base = OTHER; note = 2'-O- methyl
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- deoxyribose
  modified_base 15: mod_base = OTHER; note = 2'- deoxyribose
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
ggggtttttcttgttgacaa

SEQ ID NO: 297 - RNA, 20 nt, synthetic construct
  source 1..20: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'- fluoro
  modified_base 9: mod_base = OTHER; note = 2'-O- methyl
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- deoxyribose
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
ggggtttttcttgttgacaa

SEQ ID NO: 298 - RNA, 20 nt, synthetic construct
  source 1..20: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'- fluoro
  modified_base 9: mod_base = OTHER; note = 2'-O- methyl
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
ggggtttttcttgttgacaa

SEQ ID NO: 299 - RNA, 20 nt, synthetic construct
  source 1..20: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'- fluoro
  modified_base 9: mod_base = OTHER; note = 2'-O- methyl
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- deoxyribose
  modified_base 15: mod_base = OTHER; note = 2'- deoxyribose
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
ggggtttttcttgttgacaa

SEQ ID NO: 300 - RNA, 20 nt, synthetic construct
  source 1..20: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'- fluoro
  modified_base 9: mod_base = OTHER; note = 2'-O- methyl
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- deoxyribose
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
ggggtttttcttgttgacaa

SEQ ID NO: 301 - RNA, 20 nt, synthetic construct
  source 1..20: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'- fluoro
  modified_base 9: mod_base = OTHER; note = 2'-O- methyl
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
ggggtttttcttgttgacaa

SEQ ID NO: 302 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'- deoxyribose
  modified_base 16: mod_base = OTHER; note = 2'- deoxyribose
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
tgctgctatgcctcatcttct

SEQ ID NO: 303 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'- deoxyribose
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
tgctgctatgcctcatcttct

SEQ ID NO: 304 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
tgctgctatgcctcatcttct

SEQ ID NO: 305 - RNA, 20 nt, synthetic construct
  source 1..20: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'- fluoro
  modified_base 9: mod_base = OTHER; note = 2'-O- methyl
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- deoxyribose
  modified_base 15: mod_base = OTHER; note = 2'- deoxyribose
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
ctgctatgcctcatcttctt

SEQ ID NO: 306 - RNA, 20 nt, synthetic construct
  source 1..20: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'- fluoro
  modified_base 9: mod_base = OTHER; note = 2'-O- methyl
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- deoxyribose
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
ctgctatgcctcatcttctt

SEQ ID NO: 307 - RNA, 20 nt, synthetic construct
  source 1..20: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'- fluoro
  modified_base 9: mod_base = OTHER; note = 2'-O- methyl
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
ctgctatgcctcatcttctt

SEQ ID NO: 308 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'- deoxyribose
  modified_base 16: mod_base = OTHER; note = 2'- deoxyribose
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
cccgtctgtgccttctcatct

SEQ ID NO: 309 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'- deoxyribose
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
cccgtctgtgccttctcatct

SEQ ID NO: 310 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
cccgtctgtgccttctcatct

SEQ ID NO: 311 - RNA, 22 nt, synthetic construct
  source 1..22: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- deoxyribose
  modified_base 7: mod_base = OTHER; note = 2'- deoxyribose
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl, 3'- thiophosphate
  modified_base 21: mod_base = OTHER; note = 2'-O- methyl, 3'- thiophosphate
  modified_base 22: mod_base = OTHER; note = 2'-O- methyl
ttgtcaacaagaaaaaccccgc

SEQ ID NO: 312 - RNA, 22 nt, synthetic construct
  source 1..22: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'- deoxyribose
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl, 3'- thiophosphate
  modified_base 21: mod_base = OTHER; note = 2'-O- methyl, 3'- thiophosphate
  modified_base 22: mod_base = OTHER; note = 2'-O- methyl
ttgtcaacaagaaaaaccccgc

SEQ ID NO: 313 - RNA, 22 nt, synthetic construct
  source 1..22: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = Glycerol nucleic acid
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl, 3'- thiophosphate
  modified_base 21: mod_base = OTHER; note = 2'-O- methyl, 3'- thiophosphate
  modified_base 22: mod_base = OTHER; note = 2'-O- methyl
ttgtcaacaagaaaaaccccgc

SEQ ID NO: 314 - RNA, 22 nt, synthetic construct
  source 1..22: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'- fluoro
  modified_base 6: mod_base = OTHER; note = 2'- deoxyribose
  modified_base 7: mod_base = OTHER; note = 2'- deoxyribose
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl, 3'- thiophosphate
  modified_base 21: mod_base = OTHER; note = 2'-O- methyl, 3'- thiophosphate
  modified_base 22: mod_base = OTHER; note = 2'-O- methyl
ttgtcaacaagaaaaaccccgc

SEQ ID NO: 315 - RNA, 22 nt, synthetic construct
  source 1..22: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'- fluoro
  modified_base 6: mod_base = OTHER; note = 2'- fluoro
  modified_base 7: mod_base = OTHER; note = 2'- deoxyribose
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl, 3'- thiophosphate
  modified_base 21: mod_base = OTHER; note = 2'-O- methyl, 3'- thiophosphate
  modified_base 22: mod_base = OTHER; note = 2'-O- methyl
ttgtcaacaagaaaaaccccgc

SEQ ID NO: 316 - RNA, 22 nt, synthetic construct
  source 1..22: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'- fluoro
  modified_base 6: mod_base = OTHER; note = Glycerol nucleic acid
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl, 3'- thiophosphate
  modified_base 21: mod_base = OTHER; note = 2'-O- methyl, 3'- thiophosphate
  modified_base 22: mod_base = OTHER; note = 2'-O- methyl
ttgtcaacaagaaaaaccccgc

SEQ ID NO: 317 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- deoxyribose
  modified_base 7: mod_base = OTHER; note = 2'- deoxyribose
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
agaagatgaggcatagcagcagg

SEQ ID NO: 318 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'- deoxyribose
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
agaagatgaggcatagcagcagg

SEQ ID NO: 319 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = Glycerol nucleic acid
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
agaagatgaggcatagcagcagg

SEQ ID NO: 320 - RNA, 22 nt, synthetic construct
  source 1..22: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'- fluoro
  modified_base 4: mod_base = OTHER; note = 2'-O- methyl
  modified_base 5: mod_base = OTHER; note = 2'-O- methyl
  modified_base 6: mod_base = OTHER; note = 2'- deoxyribose
  modified_base 7: mod_base = OTHER; note = 2'- deoxyribose
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl, 3'- thiophosphate
  modified_base 21: mod_base = OTHER; note = 2'-O- methyl, 3'- thiophosphate
  modified_base 22: mod_base = OTHER; note = 2'-O- methyl
aagaagatgaggcatagcagca

SEQ ID NO: 321 - RNA, 22 nt, synthetic construct
  source 1..22: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'- fluoro
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'- deoxyribose
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl, 3'- thiophosphate
  modified_base 21: mod_base = OTHER; note = 2'-O- methyl, 3'- thiophosphate
  modified_base 22: mod_base = OTHER; note = 2'-O- methyl
aagaagatgaggcatagcagca

SEQ ID NO: 322 - RNA, 22 nt, synthetic construct
  source 1..22: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'- fluoro
  modified_base 4: mod_base = OTHER; note = 2'-O- methyl
  modified_base 5: mod_base = OTHER; note = 2'-O- methyl
  modified_base 6: mod_base = OTHER; note = Glycerol nucleic acid
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl, 3'- thiophosphate
  modified_base 21: mod_base = OTHER; note = 2'-O- methyl, 3'- thiophosphate
  modified_base 22: mod_base = OTHER; note = 2'-O- methyl
aagaagatgaggcatagcagca

SEQ ID NO: 323 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- deoxyribose
  modified_base 7: mod_base = OTHER; note = 2'- deoxyribose
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
agatgagaaggcacagacgggga

SEQ ID NO: 324 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = 2'- fluoro
  modified_base 7: mod_base = OTHER; note = 2'- deoxyribose
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
agatgagaaggcacagacgggga

SEQ ID NO: 325 - RNA, 23 nt, synthetic construct
  source 1..23: mol_type = other RNA
  modified_base 1: mod_base = OTHER; note = 5'-Vinyl-(E)-phosphono, 2'-O- methyl, 3'- thiophosphate
  modified_base 2: mod_base = OTHER; note = 2'- fluoro, 3'- thiophosphate
  modified_base 3: mod_base = OTHER; note = 2'-O- methyl
  modified_base 4: mod_base = OTHER; note = 2'- fluoro
  modified_base 5: mod_base = OTHER; note = 2'- fluoro
  modified_base 6: mod_base = OTHER; note = Glycerol nucleic acid
  modified_base 7: mod_base = OTHER; note = 2'-O- methyl
  modified_base 8: mod_base = OTHER; note = 2'-O- methyl
  modified_base 9: mod_base = OTHER; note = 2'-O- methyl
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- fluoro
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl, 3'- thiophosphate
  modified_base 22: mod_base = OTHER; note = 2'-O- methyl, 3'- thiophosphate
  modified_base 23: mod_base = OTHER; note = 2'-O- methyl
agatgagaaggcacagacgggga

SEQ ID NO: 326 - RNA, 20 nt, synthetic construct
  source 1..20: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'- fluoro
  modified_base 9: mod_base = OTHER; note = 2'-O- methyl
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  misc_binding 20: bound_moiety = G5
ggggtttttcttgttgacaa

SEQ ID NO: 327 - RNA, 20 nt, synthetic construct
  source 1..20: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'- fluoro
  modified_base 9: mod_base = OTHER; note = 2'-O- methyl
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  misc_binding 20: bound_moiety = G101
ggggtttttcttgttgacaa

SEQ ID NO: 328 - RNA, 20 nt, synthetic construct
  source 1..20: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'- fluoro
  modified_base 9: mod_base = OTHER; note = 2'-O- methyl
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  misc_binding 20: bound_moiety = G103
ggggtttttcttgttgacaa

SEQ ID NO: 329 - RNA, 20 nt, synthetic construct
  source 1..20: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'- fluoro
  modified_base 9: mod_base = OTHER; note = 2'-O- methyl
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  misc_binding 20: bound_moiety = G5
ggggtttttcttgttgacaa

SEQ ID NO: 330 - RNA, 20 nt, synthetic construct
  source 1..20: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'- fluoro
  modified_base 9: mod_base = OTHER; note = 2'-O- methyl
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  misc_binding 20: bound_moiety = G101
ggggtttttcttgttgacaa

SEQ ID NO: 331 - RNA, 20 nt, synthetic construct
  source 1..20: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'- fluoro
  modified_base 9: mod_base = OTHER; note = 2'-O- methyl
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  misc_binding 20: bound_moiety = G103
ggggtttttcttgttgacaa

SEQ ID NO: 332 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
  misc_binding 21: bound_moiety = G5
cccgtctgtgccttctcatct

SEQ ID NO: 333 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
  misc_binding 21: bound_moiety = G101
cccgtctgtgccttctcatct

SEQ ID NO: 334 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
  misc_binding 21: bound_moiety = G103
cccgtctgtgccttctcatct

SEQ ID NO: 335 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
  misc_binding 21: bound_moiety = G5
ccggaccgtgtgcacttcgct

SEQ ID NO: 336 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
  misc_binding 21: bound_moiety = G101
ccggaccgtgtgcacttcgct

SEQ ID NO: 337 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
  misc_binding 21: bound_moiety = G103
ccggaccgtgtgcacttcgct

SEQ ID NO: 338 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
  misc_binding 21: bound_moiety = G5
gaccgtgtgcacttcgcttca

SEQ ID NO: 339 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
  misc_binding 21: bound_moiety = G101
gaccgtgtgcacttcgcttca

SEQ ID NO: 340 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
  misc_binding 21: bound_moiety = G103
gaccgtgtgcacttcgcttca

SEQ ID NO: 341 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
  misc_binding 21: bound_moiety = G5
gaccgtgtgcacttcgcttca

SEQ ID NO: 342 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
  misc_binding 21: bound_moiety = G101
gaccgtgtgcacttcgcttca

SEQ ID NO: 343 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
  misc_binding 21: bound_moiety = G103
gaccgtgtgcacttcgcttca

SEQ ID NO: 344 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
  misc_binding 21: bound_moiety = G5
cggaccgtgtgcacttcgctt

SEQ ID NO: 345 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
  misc_binding 21: bound_moiety = G101
cggaccgtgtgcacttcgctt

SEQ ID NO: 346 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
  misc_binding 21: bound_moiety = G103
cggaccgtgtgcacttcgctt

SEQ ID NO: 347 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'- deoxyribose
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
  misc_binding 21: bound_moiety = G5
tgctgctatgcctcatcttct

SEQ ID NO: 348 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'- deoxyribose
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
  misc_binding 21: bound_moiety = G101
tgctgctatgcctcatcttct

SEQ ID NO: 349 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'- fluoro
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'- deoxyribose
  modified_base 16: mod_base = OTHER; note = 2'-O- methyl
  modified_base 17: mod_base = OTHER; note = 2'- fluoro
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
  misc_binding 21: bound_moiety = G103
tgctgctatgcctcatcttct

SEQ ID NO: 350 - RNA, 20 nt, synthetic construct
  source 1..20: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'- fluoro
  modified_base 9: mod_base = OTHER; note = 2'-O- methyl
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- deoxyribose
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  misc_binding 20: bound_moiety = G5
ctgctatgcctcatcttctt

SEQ ID NO: 351 - RNA, 20 nt, synthetic construct
  source 1..20: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'- fluoro
  modified_base 9: mod_base = OTHER; note = 2'-O- methyl
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- deoxyribose
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  misc_binding 20: bound_moiety = G101
ctgctatgcctcatcttctt

SEQ ID NO: 352 - RNA, 20 nt, synthetic construct
  source 1..20: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'- fluoro
  modified_base 7: mod_base = OTHER; note = 2'-O- methyl
  modified_base 8: mod_base = OTHER; note = 2'- fluoro
  modified_base 9: mod_base = OTHER; note = 2'-O- methyl
  modified_base 10: mod_base = OTHER; note = 2'- fluoro
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'- deoxyribose
  modified_base 15: mod_base = OTHER; note = 2'-O- methyl
  modified_base 16: mod_base = OTHER; note = 2'- fluoro
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  misc_binding 20: bound_moiety = G103
ctgctatgcctcatcttctt

SEQ ID NO: 353 - RNA, 19 nt, synthetic construct
  source 1..19: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'- fluoro
  modified_base 6: mod_base = OTHER; note = 2'-O- methyl
  modified_base 7: mod_base = OTHER; note = 2'- fluoro
  modified_base 8: mod_base = OTHER; note = 2'- fluoro
  modified_base 9: mod_base = OTHER; note = 2'- fluoro
  modified_base 10: mod_base = OTHER; note = 2'-O- methyl
  modified_base 11: mod_base = OTHER; note = 2'-O- methyl
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  misc_binding 19: bound_moiety = GL
gtgtgcacttcgcttcaca

SEQ ID NO: 354 - RNA, 21 nt, synthetic construct
  source 1..21: mol_type = other RNA
  modified_base 1: mod_base = OTHER; note = 2'-O- methyl, 3'- thiophosphate
  modified_base 2: mod_base = OTHER; note = 2'-O- methyl, 3'- thiophosphate
  modified_base 3: mod_base = OTHER; note = 2'-O- methyl
  modified_base 4: mod_base = OTHER; note = 2'-O- methyl
  modified_base 5: mod_base = OTHER; note = 2'-O- methyl
  modified_base 6: mod_base = OTHER; note = 2'-O- methyl
  modified_base 7: mod_base = OTHER; note = 2'- fluoro
  modified_base 8: mod_base = OTHER; note = 2'-O- methyl
  modified_base 9: mod_base = OTHER; note = 2'- fluoro
  modified_base 10: mod_base = OTHER; note = 2'-O- methyl
  modified_base 11: mod_base = OTHER; note = 2'- fluoro
  modified_base 12: mod_base = OTHER; note = 2'-O- methyl
  modified_base 13: mod_base = OTHER; note = 2'-O- methyl
  modified_base 14: mod_base = OTHER; note = 2'-O- methyl
  modified_base 15: mod_base = OTHER; note = 2'-O- methyl
  modified_base 16: mod_base = OTHER; note = 2'-O- methyl
  modified_base 17: mod_base = OTHER; note = 2'-O- methyl
  modified_base 18: mod_base = OTHER; note = 2'-O- methyl
  modified_base 19: mod_base = OTHER; note = 2'-O- methyl
  modified_base 20: mod_base = OTHER; note = 2'-O- methyl
  modified_base 21: mod_base = OTHER; note = 2'-O- methyl
  misc_binding 21: bound_moiety = G5
ggtctcttctatcgatcttat

The invention claimed is:

1. A double-stranded RNAi agent, wherein the double-stranded RNAi agent comprises an antisense strand and a sense strand complementary to the antisense strand forming a double-stranded region, wherein a nucleotide sequence of the antisense strand is a modified sequence of a sequence shown in SEQ ID NO: 8;

wherein a nucleotide sequence of the sense strand is a modified sequence of a sequence shown in SEQ ID NO: 1;

wherein the double-stranded RNAi agent comprises an oligonucleotide duplex selected from any one of the following sense and antisense strand pairs:

(1) the sense strand has the sequence as shown in SEQ ID NO: 81, and the antisense strand has the sequence as shown in SEQ ID NO: 179, 180, 181, 182, or 184;

(2) the sense strand has the sequence as shown in SEQ ID NO: 82, and the antisense strand has the sequence as shown in SEQ ID NO: 179, 180, or 183.

2. The double-stranded RNAi agent according to claim 1, wherein the double-stranded RNAi agent has the function of inhibiting HBV gene expression.

3. The double-stranded RNAi agent according to claim 1, wherein the antisense strand is modified with modifying groups from the second to the eighth positions starting from the 5' end, where the modifying groups are selected from one or more of UNA, GNA, and DNA, and the structures of UNA and GNA are

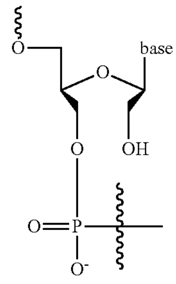

Unlocked nucleic acid (UNA)

and

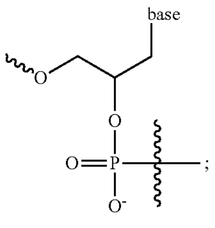

Glycol nucleic acid (GNA)

the base is selected from any one of adenine, guanine, cytosine, thymine, and uracil.

4. A conjugate, wherein the conjugate comprises the double-stranded RNAi agent according to claim 1 and a ligand conjugated to the double-stranded RNAi agent, wherein the ligand is conjugated to a 3'-end or a 5'-end of an oligonucleotide sense strand, or wherein the ligand is one or more GalNAc derivatives attached via a bivalent or trivalent branched linker, or a GalNAc derivative attached via a monovalent linker, or wherein the ligand is:

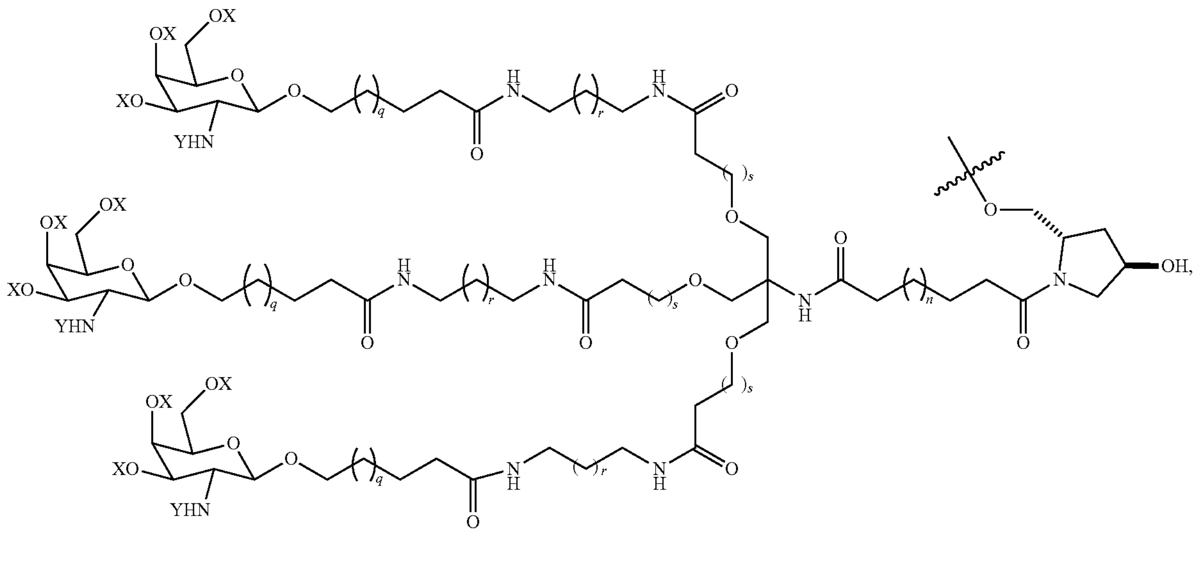

wherein X is hydrogen, a hydroxyl protecting group, or H, and the hydroxyl protecting group includes acetyl, benzoyl, or isobutyryl; Y is an amine protecting group or H, and the amine protecting group is formyl, acetyl, propionyl, n-butyryl, or isobutyryl; n is an integer between 0 and 20; q, r, and s are independently integers between 1 and 7, or wherein the ligand is:

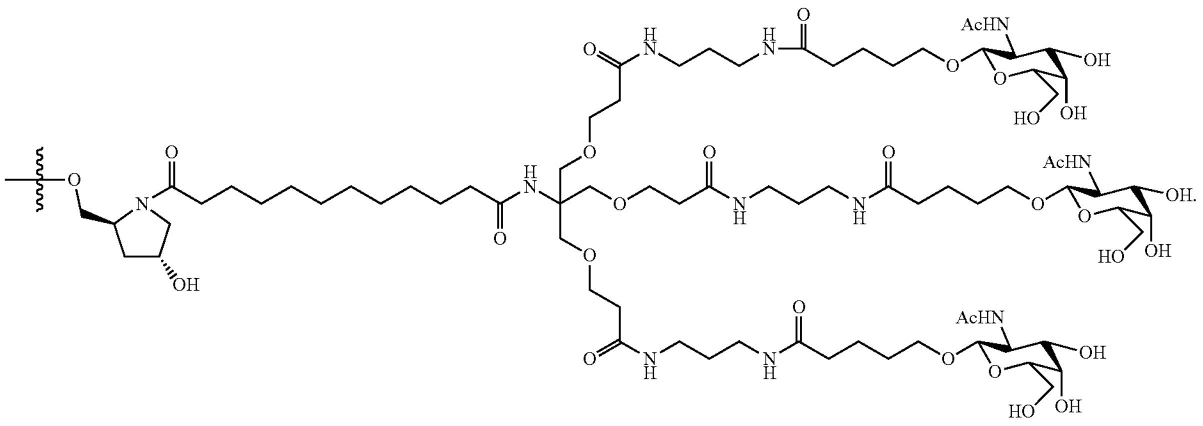

5. The conjugate according to claim 4, wherein the ligand is:

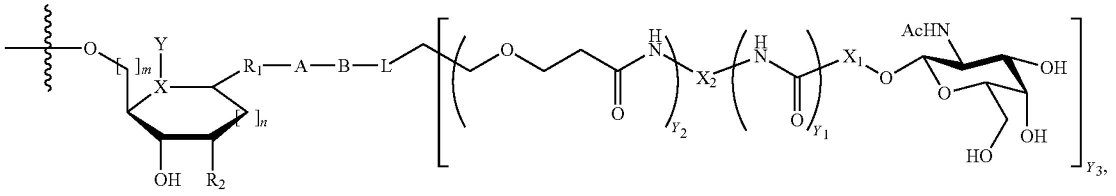

wherein X is oxygen, nitrogen, or sulfur;

Y is an alkyl or aromatic group;

$R_1$ is oxygen or sulfur;

$R_2$ is hydrogen, an amino group, a $C_{1-4}$ alkyl group, an aromatic group, a $C_{1-4}$ alkoxy group, or a halogen;

A is $—(CH_2)_a—$, $—(CH_2CH_2O)_b—$, $—((CH_2)_c NHCO)_d—$, or $—((CH_2)_cCONH)_d—$, where a is an integer from 1 to 15, b is an integer from 1 to 7, c is an integer from 1 to 7, and d is an integer from 1 to 5;

B is $—(CH_2)_e—$, where e is an integer from 0 to 7;

L is —CONH— or —NHCO—;

$X_1$ is $—(CH_2)_f—$ or $—(CH_2CH_2O)_fCH_2—$, where f is an integer from 1 to 5;

$X_2$ is $—(CH_2)_g—$, where g is an integer from 1 to 6;

$Y_1$ is 0 or 1;

$Y_2$ is 0, 1, or 2;

$Y_3$ is 1, 2, or 3;

m is an integer from 0 to 4;

n is an integer from 0 to 4, wherein the ligand is G4, G5, G6, or G7:

G4

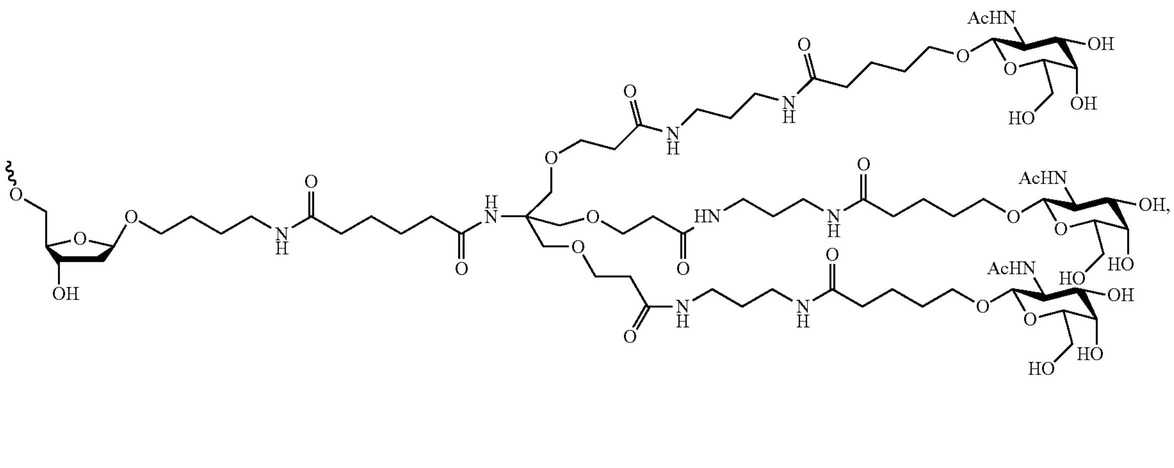

-continued
G5
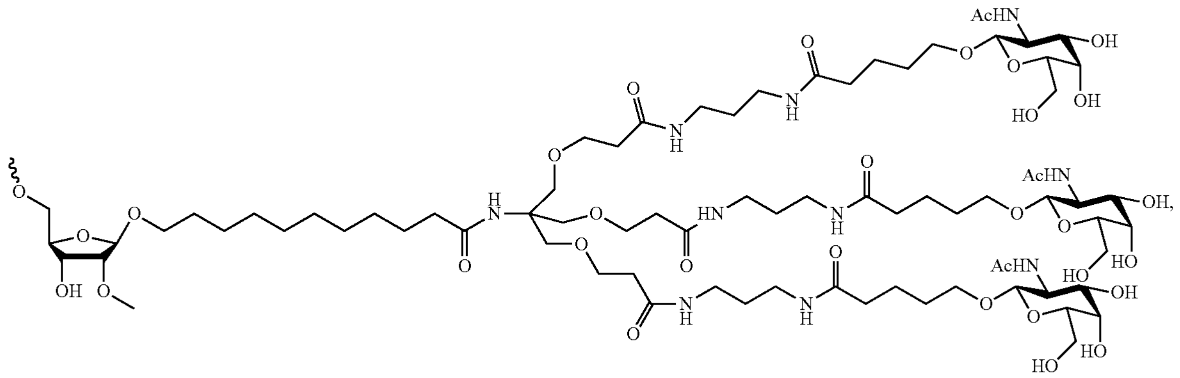
G6
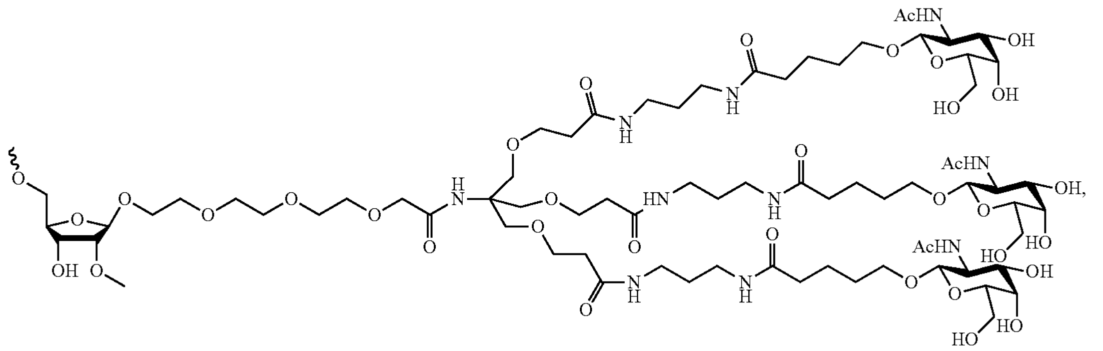
or
G7
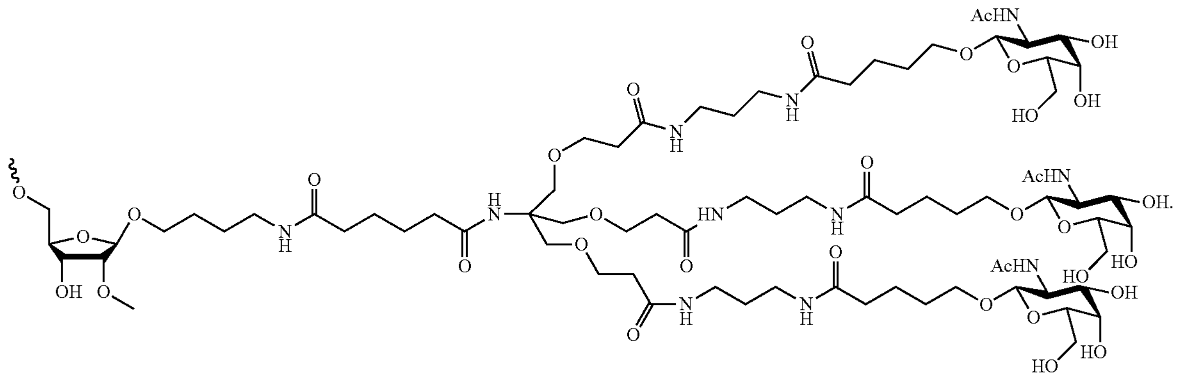
wherein the conjugate is represented by the following structures:
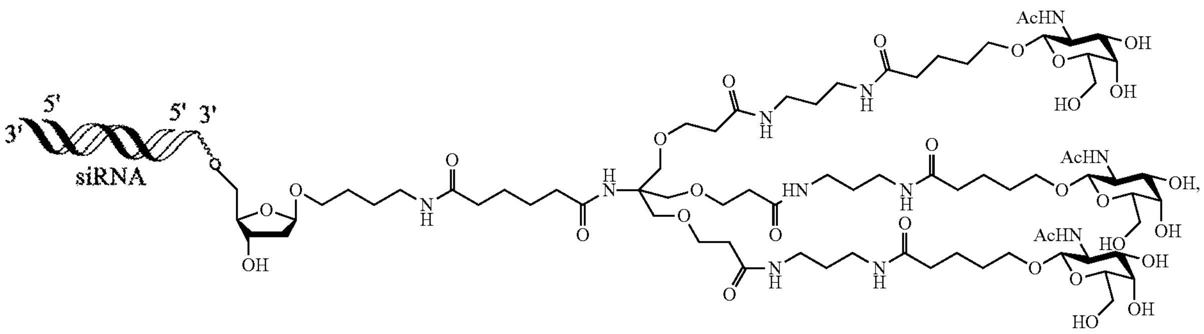

-continued
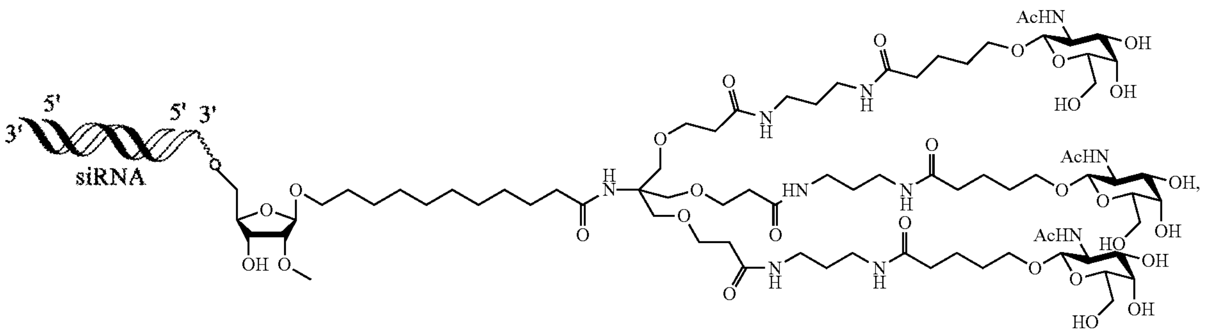
,
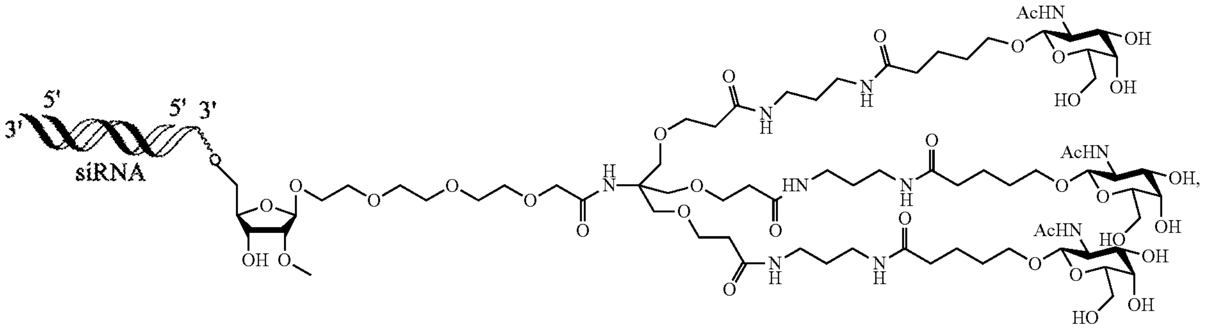
,
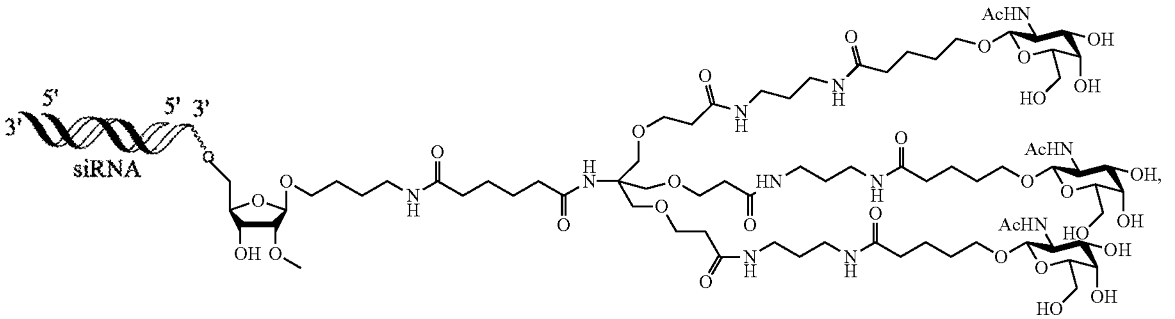
, or
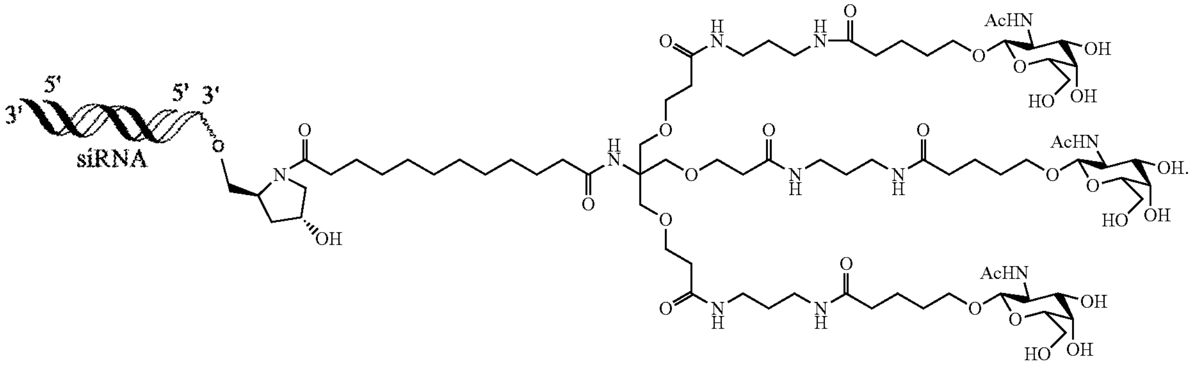
.

6. The conjugate according to claim 4, wherein the ligand is:

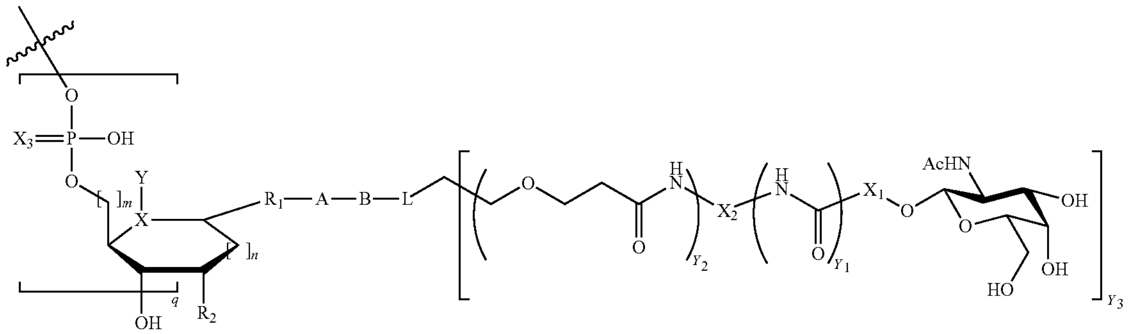

wherein X is oxygen, nitrogen, or sulfur;

Y is an alkyl or aromatic group;

$R_1$ is oxygen or sulfur;

$R_2$ is hydrogen, an amino group, a $C_{1-4}$ alkyl group, an aromatic group, a $C_{1-4}$ alkoxy group, or a halogen;

A is $—(CH_2)_a—$, $—(CH_2CH_2O)_b—$, $—((CH_2)_cNHCO)_d—$, or $—((CH_2)_cCONH)_d—$, where a is an integer from 1 to 15, b is an integer from 1 to 7, c is an integer from 1 to 7, and d is an integer from 1 to 5;

B is $—(CH_2)_e—$, where e is an integer from 0 to 7;

L is —CONH— or —NHCO—;

$X_1$ is $—(CH_2)_f—$ or $—(CH_2CH_2O)_fCH_2—$, where f is an integer from 1 to 5;

$X_2$ is $—(CH_2)_g—$, where g is an integer from 1 to 6;

$Y_1$ is 0 or 1;

$Y_2$ is 0, 1, or 2;

$Y_3$ is 1, 2, or 3;

m is an integer from 0 to 4;

n is an integer from 0 to 4, wherein the ligand is G101, G102, G103, G105, or G106:

G101

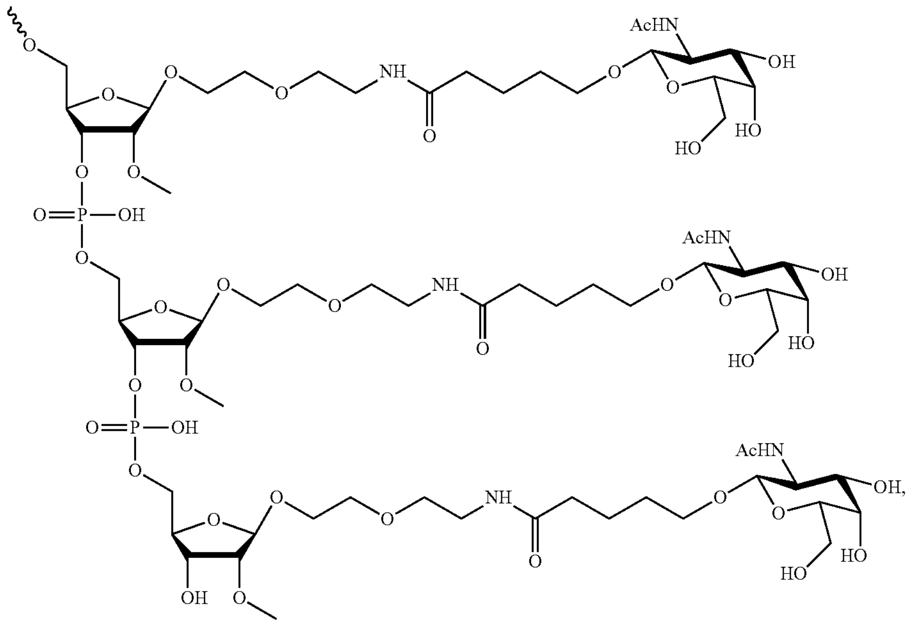

-continued
G102
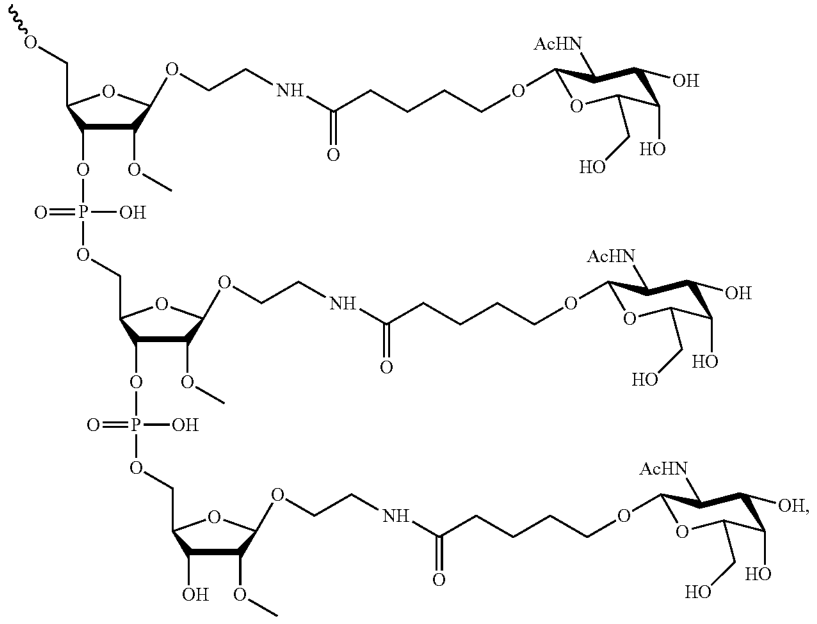
G103
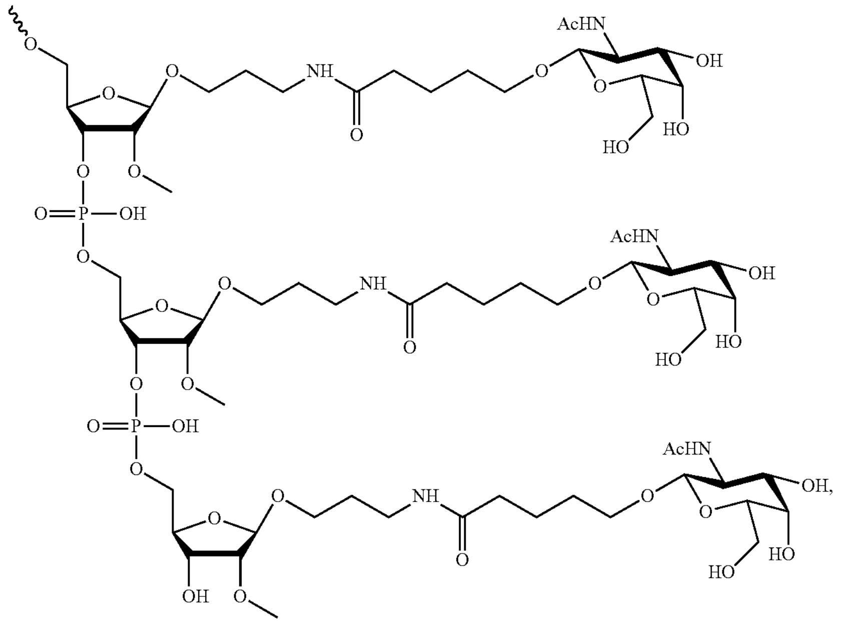

-continued

G105

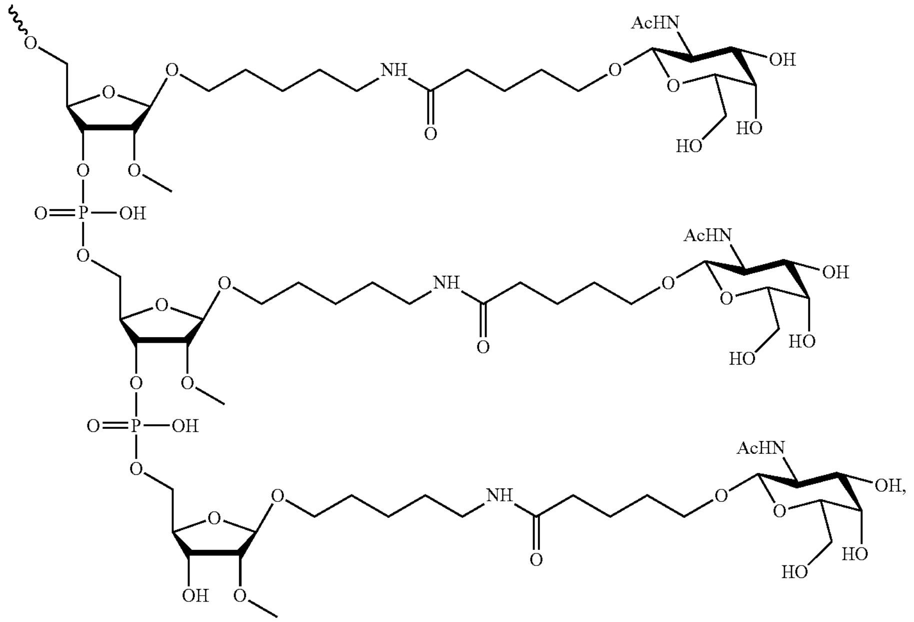

or

G106

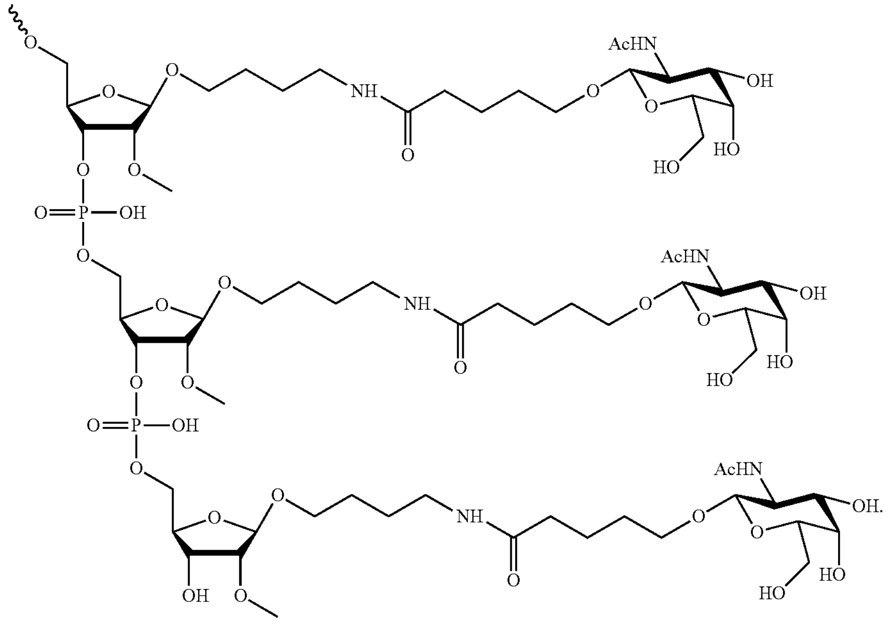

7. The conjugate according to claim 4, wherein the conjugate comprises an oligonucleotide duplex selected from any one of the following sense and antisense strand pairs:

(1) the sense strand has the sequence as shown in SEQ ID NO: 326, 327 or 328, and the antisense strand has the sequence as shown in SEQ ID NO: 179;

(2) the sense strand has the sequence as shown in SEQ ID NO: 329, 330 or 331, and the antisense strand has the sequence as shown in SEQ ID NO: 181.

8. The conjugate according to claim 4, wherein the conjugate has the function of inhibiting HBV gene expression.

9. A pharmaceutical composition comprising the double-stranded RNAi agent according to claim 1, along with a pharmaceutically acceptable carrier.

10. A kit comprising a kit A, wherein the kit A comprises one or more of the double-stranded RNAi agent according to claim 1, wherein the kit further comprises a kit B, and the kit B comprises one or both of the following:

(1) an additional drug that reduces HBV gene expression or a composition comprising the drug that reduces HBV gene expression;

(2) one or more agents selected from the group consisting of hormone preparations, targeted small molecule agents, proteasome inhibitors, imaging agents, diagnostic agents, chemotherapeutic agents, oncolytic drugs, cytotoxic agents, cytokines, activators of co-stimulatory molecules, inhibitors of inhibitory molecules, and vaccines.

11. A method for preventing and/or treating a disease associated with HBV gene expression or reducing HBV gene expression or inhibiting HBV replication for non-preventive and/or non-therapeutic purposes, wherein the method comprises administering to a sample the double-stranded RNAi agent according to claim 1, wherein the disease associated with HBV gene expression is selected from the following disease types: chronic hepatitis B, liver fibrosis, liver cirrhosis, liver cancer, acute hepatitis B, and HBV/hepatitis D virus co-infection-associated diseases.

12. The conjugate according to claim 4, wherein the conjugate is represented by the following structures:

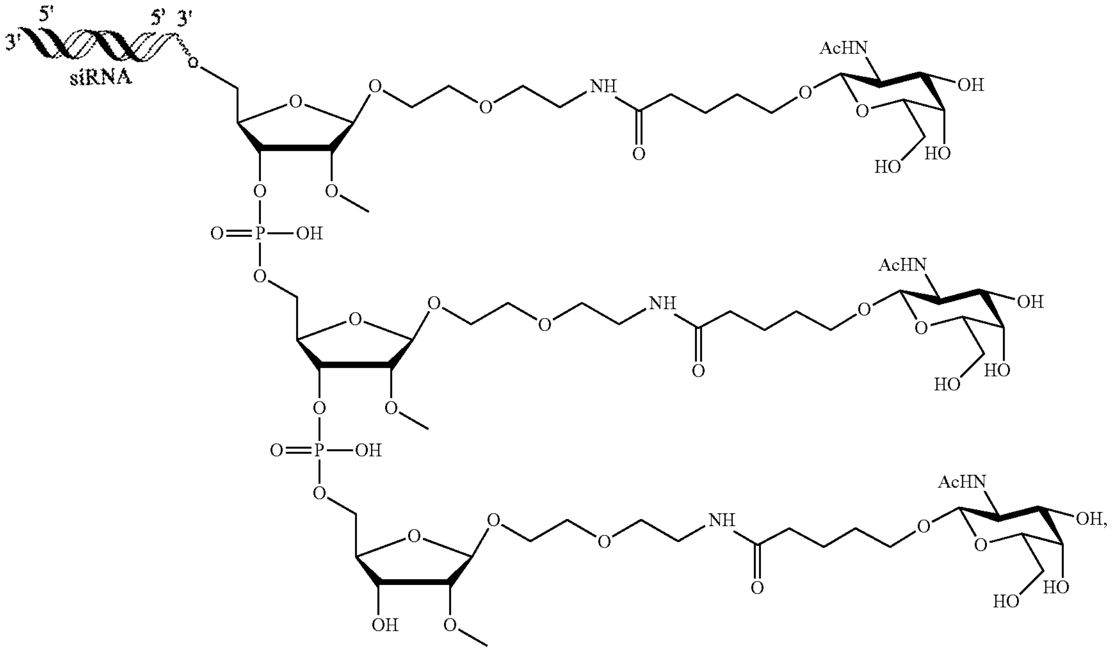

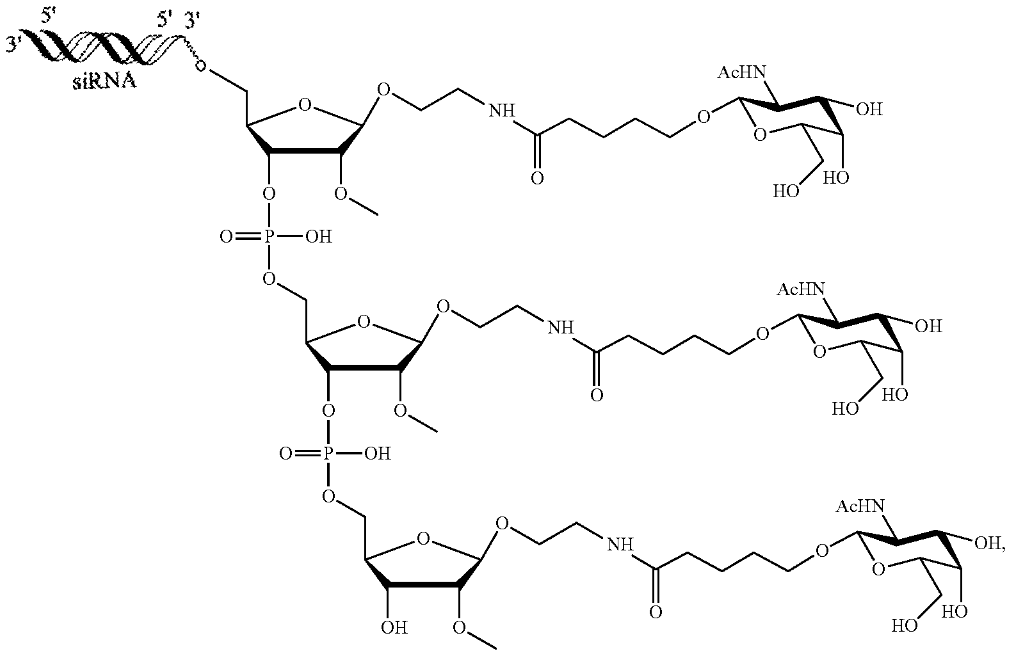

-continued
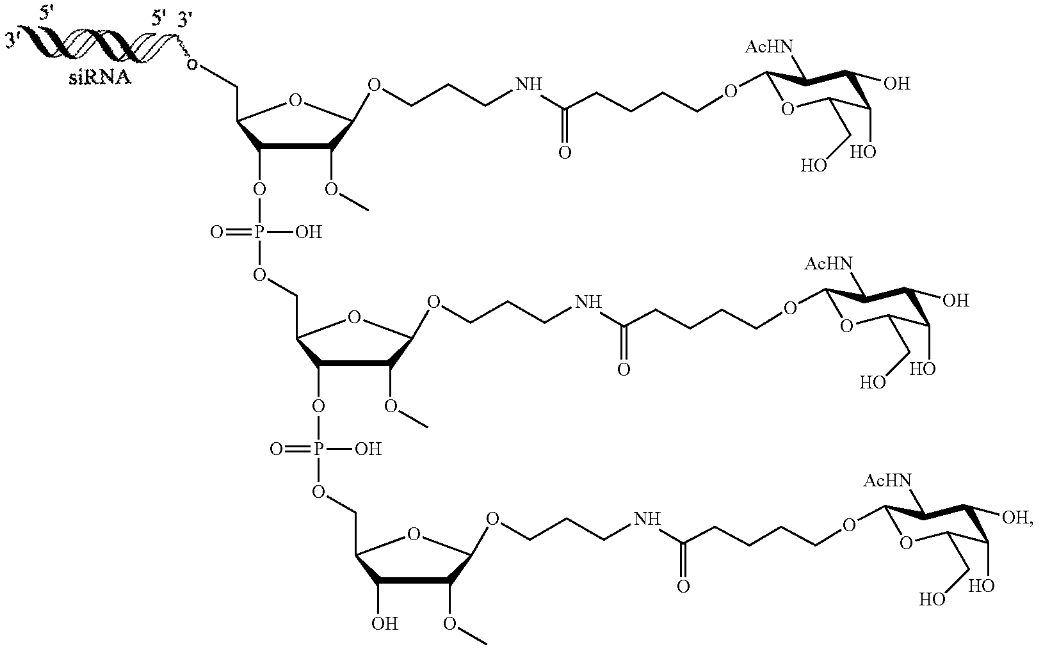
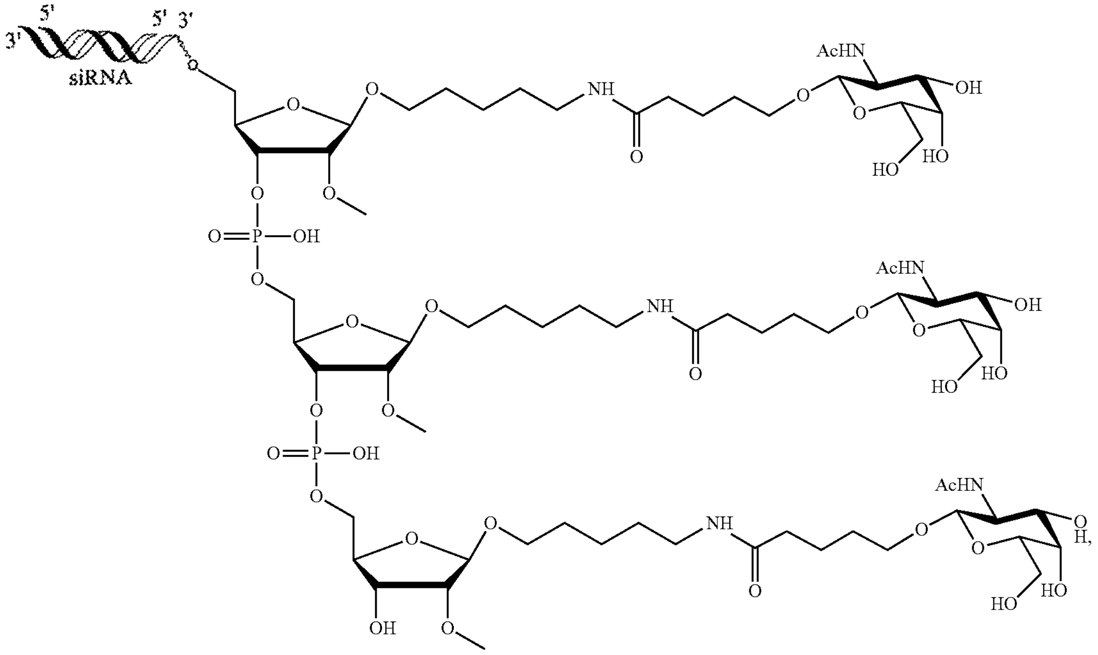
or

-continued
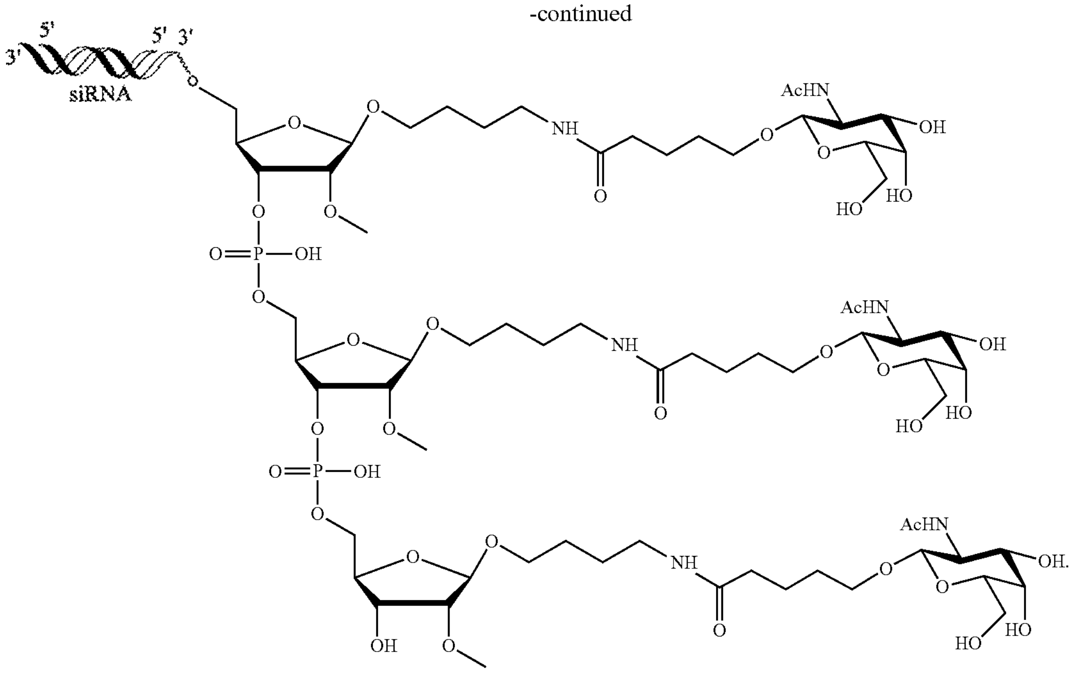
* * * * *